(12) United States Patent
Gelfman et al.

(10) Patent No.: US 12,370,257 B2
(45) Date of Patent: *Jul. 29, 2025

(54) MATERIALS AND METHODS OF TREATING MHC-I-OPATHY RISK HAPLOTYPES

(71) Applicant: Regeneron Pharmaceuticals, Inc., Tarrytown, NY (US)

(72) Inventors: Sahar Gelfman, Tarrytown, NY (US); Ann Ligocki, Tarrytown, NY (US); Giovanni Coppola, Tarrytown, NY (US); Aris Baras, Tarrytown, NY (US); Arden Moscati, Tarrytown, NY (US); Eli A. Stahl, Tarrytown, NY (US); Jack A. Kosmicki, Tarrytown, NY (US); Manuel Allen Revez Ferreira, Tarrytown, NY (US); Carmelo Romano, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 8 days.

This patent is subject to a terminal disclaimer.

(21) Appl. No.: 17/714,717

(22) Filed: Apr. 6, 2022

(65) Prior Publication Data

US 2022/0323581 A1    Oct. 13, 2022

Related U.S. Application Data

(60) Provisional application No. 63/171,672, filed on Apr. 7, 2021.

(51) Int. Cl.
*A61K 39/395*    (2006.01)
*A61K 31/713*    (2006.01)
(Continued)

(52) U.S. Cl.
CPC ........ *A61K 39/3955* (2013.01); *A61K 31/713* (2013.01); *C07K 16/2833* (2013.01); *C07K 16/40* (2013.01)

(58) Field of Classification Search
CPC .. A61K 39/3955; A61K 31/713; A61K 45/06; A61K 31/7088; C07K 16/2833;
(Continued)

(56) References Cited

U.S. PATENT DOCUMENTS

| 8,969,254 B2 | 3/2015 | Reinherz et al. |
| 9,617,596 B2 | 4/2017 | Comabella et al. |

(Continued)

FOREIGN PATENT DOCUMENTS

| WO | 2012047294 | 4/2012 |
| WO | 2014171800 | 10/2014 |

(Continued)

OTHER PUBLICATIONS

Chen et al. (Ann Rheum Dis 2016;75:916-923).*

(Continued)

*Primary Examiner* — Terra C Gibbs
(74) *Attorney, Agent, or Firm* — Armstrong Teasdale LLP

(57) ABSTRACT

The present disclosure provides methods of treating subjects having an immune disorder by administering to the subject a therapeutically effective amount of an Endoplasmic Reticulum Aminopeptidase 2 (ERAP2) inhibitor in combination with an HLA-A29 or HLA-B27 inhibitory nucleic acid molecule.

13 Claims, 8 Drawing Sheets

Specification includes a Sequence Listing.

(51) Int. Cl.
    *C07K 16/28* (2006.01)
    *C07K 16/40* (2006.01)
(58) Field of Classification Search
    CPC .......... C07K 16/40; C12N 9/485; C12Q 1/00;
                                                C12Q 1/6881
    See application file for complete search history.

(56) References Cited

U.S. PATENT DOCUMENTS

| | | | |
|---|---|---|---|
| 9,907,833 | B2 | 3/2018 | Conrad |
| 10,047,396 | B2 | 8/2018 | Sharp et al. |
| 10,166,210 | B2 | 1/2019 | Pogue-Geile et al. |
| 10,385,398 | B2 | 8/2019 | Hakonarson et al. |
| 10,407,725 | B2 | 9/2019 | Hakonarson et al. |
| 10,927,412 | B2 | 2/2021 | Giudice et al. |
| 2012/0015904 | A1 | 1/2012 | Sharp et al. |
| 2013/0259876 | A1 | 10/2013 | Murphy et al. |
| 2015/0141273 | A1 | 5/2015 | Bosch et al. |
| 2016/0145687 | A1 | 5/2016 | Kallionpaa et al. |
| 2017/0199196 | A1 | 7/2017 | Bosch et al. |
| 2019/0076391 | A1 | 3/2019 | Pogue-Geile et al. |
| 2019/0136322 | A1 | 5/2019 | Kallionpaa et al. |
| 2019/0241633 | A1 | 8/2019 | Fotin-Mleczek et al. |
| 2019/0375842 | A1 | 12/2019 | Drake |
| 2020/0080152 | A1 | 3/2020 | Hakonarson et al. |
| 2021/0002296 | A1 | 1/2021 | Mainolfi et al. |
| 2021/0147799 | A1 | 5/2021 | Zhang et al. |

FOREIGN PATENT DOCUMENTS

| | | |
|---|---|---|
| WO | 2017208001 | 12/2017 |
| WO | 202111376 | 6/2021 |
| WO | 2021113805 | 6/2021 |

OTHER PUBLICATIONS

José A. López de Castro (Frontiers in Immunology, 2018 vol. 9, Article 2463).*
Worth et al. (Curr Treat Options in Rheum (2018) 4:174-182).*
Kuiper et al. (Hum Mol Genet. Nov. 15, 2014; 23(22): 6081-6087).*
Bousquet et al. (J. Clin. Med. 2022, 11, 4772, pp. 1-17).*
Freitas-Neto et al. (Arq Bras Oftalmol. 2015;78(1):56-61).*
Ferenchak et al. (Seminars in Ophthalmology 2021, vol. 36, Nos. 5-6, 452-457).*
Hu et al. (Nucleic Acid Therapeutics, vol. 33, No. 6, 2023, 339-347).*
Alejandro Garanto (Methods in Molecular Biology 2434, 2021 Springer Protocols, Chapter 22, pp. 321-332).*
Vázquez-Domínguez et al. (Nucleic Acids Research, 2024, vol. 52:10447-10463).*
Castro-Santos et al., "ERAP1 and HLA-C interaction in inflammatory bowel disease in the Spanish population", Innate Immunity, 2017, 23(5), pp. 476-481.
Chiaroni-Clarke et al., "Independent confirmation of juvenile idiopathic arthritis genetic risk loci previously identified by immunochip array analysis", Pediatric Rheumatology, 2014, 12(53), pp. 1-4.
Deddouche-Grass et al., "Discovery and Optimization of a Series of Benzofuran Selective ERAP1 Inhibitors: Biochemical and In Silico Studies", ACS Med Chem Lett, 2021, 12, pp. 1137-1142.
Franke et al., "Genome-wide meta-analysis increases to 71 the number of confirmed Crohn's disease susceptibility loci", Nature Genetics, 2010, 42(12), pp. 1118-1126.
Liddle et al., "Targeting the Regulatory Site of ER Aminopeptidase 1 Leads to the Discovery of a Natural Product Modulator of Antigen Presentation", J Med Chem, 2020, 63(6), pp. 3348-3358.
Weglarz-Tomczak et al., "Discovery of potent and selective inhibitors of human aminopeptidases ERAP1 and ERAP2 by screening libraries of phosphorus-containing amino acid and dipeptide analogues", Bioorganic and Medicinal Chemistry Letters, 2016, 26, pp. 4122-4126.
Zervoudi et al., "Rationally designed inhibitor targeting antigentrimming aminopeptidases enhances antigen presentation and cytotoxic T-cell responses", PNAS, 2013, 110(49), pp. 19890-19895.
Van Hout et al., "Exome sequencing and characterization of 49,960 individuals in the UK Biobank", Nature, 2020, 586(7831), pp. 749-756.
Reid et al., "Launching genomics into the cloud: deployment of Mercury, a next generation sequence analysis pipeline", BMC Bioinformatics, 2014, 15(30), pp. 1-11.
Bai et al., "Inference of high resolution HLA types using genome-wide RNA or DNA sequencing reads", BMC Genomics, 2014, 15(325), pp. 1-16.
Robinson et al., "The IPD-IMGT/HLA Database—New developments in reporting HLA variation", Hum Immunol, 2016, 77(3), pp. 233-237.
Jia et al., "Imputing Amino Acid Polymorphisms in Human Leukocyte Antigens", PLOS One, 2013, 8(6), pp. e64683.
Rich et al., "The Type 1 Diabetes Genetics Consortium", Ann NY Acad Sci, 2006, 1079, pp. 1-8.
Delaneau et al., "Accurate, scalable and integrative haplotype estimation", Nature Communications, 2019, 10(5436), pp. 1-10.
Das et al., "Next-generation genotype imputation service and methods", Nat Genet, 2016, 48(10), pp. 1284-1287.
Mbatchou et al., "Computationally efficient whole genome regression for quantitative and binary traits", BioRxiv, 2020, pp. 1-88.
Zhou et al., "Efficiently controlling for case-control imbalance and sample relatedness in large-scale genetic association studies", Nature Genetics, 2018, 50, pp. 1335-1341.
Purcell et al., "PLINK: a tool set for whole-genome association and population-based linkage analyses", Am J Hum Genet, 2007, 81(3), pp. 559-575.
Kuiper et al., "A genome-wide association study identifies a functional ERAP2 haplotype associated with birdshot chorioretinopathy", Hum Mol Genet, 2014, 23(22), pp. 6081-6087.
Kuiper et al., "Functionally distinct ERAP1 and ERAP2 are a hallmark of HLA-A29-(Birdshot) Uveitis", Hum Mol Genet, 2018, 27(24), pp. 4333-4343.
Paladini et al., "An allelic variant in the intergenic region between ERAP1 and ERAP2 correlates with an inverse expression of the two genes", Scientific Reports, 2018, 8(10398), pp. 1-10.
Andres et al., "Balancing Selection Maintains a Form of ERAP2 that Undergoes Nonsense-Mediated Decay and Affects Antigen Presentation", PLOS Genetics, 2010, 6(10), pp. e1001157.
Coulombe-Huntington et al., "Fine-Scale Variation and Genetic Determinants of Alternative Splicing across Individuals", PLOS Genetics, 2009, 5(12), pp. e1000766.
Sanz-Bravo et al., "Allele-specific Alterations in the Peptidome Underlie the Joint Association of HLA-A*29:02 and Endoplasmic Reticulum Aminopeptidase 2 (ERAP2) with Birdshot Chorioretinopathy", Mol Cell Proteomics, 2018, 17(8), pp. 1564-1577.
Yao et al., "Influence of ERAP1 and ERAP2 gene polymorphisms on disease susceptibility in different populations", Human Immunology, 2019, 80(5), pp. 325-334.
Evans et al., "Interaction between ERAP1 and HLA-B27 in ankylosing spondylitis implicates peptide handling in the mechanism for HLA-B27 in disease susceptibility", Nat Genet, 2011, 43(8), pp. 761-767.
Wisniewski et al., "The association of ERAP1 and ERAP2 single nucleotide polymorphisms and their haplotypes with psoriasis vulgaris is dependent on the presence or absence of the HLA-C*06:02 allele and age at disease onset", Hum Immunol, 2018, 79(2), pp. 109-116.
Strange et al., "A genome-wide association study identifies new psoriasis susceptibility loci and an interaction between HLA-C and ERAP1", Nat Genet, 2010, 42(11), pp. 985-990.
Takeuchi et al., "A single endoplasmic reticulum aminopeptidase-1 protein allotype is a strong risk factor for Behçet's disease in HLA-B*51 carriers", Ann Rheum Dis, 2016, 75(12), pp. 2208-2211.
Sanz-Bravo et al., "Ranking the Contribution of Ankylosing Spondylitis-associated Endoplasmic Reticulum Aminopeptidase 1 (ERAP1) Polymorphisms to Shaping the HLA-B*27 Peptidome*", Mol Cell Proteomics, 2018, 17(7), pp. 1308-1323.

(56) References Cited

OTHER PUBLICATIONS

Guasp et al., "The Behçet's disease-associated variant of the aminopeptidase ERAP1 shapes a low-affinity HLA-B*51 peptidome by differential subpeptidome processing", J Biol Chem, 2017, 292(23), pp. 9680-9689.

Mckenzie et al., "Taxonomic hierarchy of HLA class I allele sequences", Genes and Immunity, 1999, 1, pp. 120-129.

Maben et al., "Discovery of Selective Inhibitors of Endoplasmic Reticulum Aminopeptidase 1", J Med Chem, 2020, 63, pp. 103-121.

Georgiadis et al. "Inhibitiors of ER Aminopeptidase 1 and 2: From Design to Clinical Application", Current Medicinal Chemistry, 2019, 26(15), pp. 2715-2729.

De Castro et al., "Molecular and pathogenic effects of endoplasmic reticulum aminopeptidases ERAP1 and ERAP2 in MHC-I-associated inflammatory disorders: Towards a unifying view", Molecular Immunology, 2016, 77, pp. 193-204.

Agrawal et al., "Genetic associations and functional characterization of M1 aminopeptidases and immune-mediated diseases", Genes and Immunity, 2014, 15(8), pp. 521-527.

Dimopoulou et al., "Variant in ERAP1 promoter region is associated with low expression in a patient with a Behcet-like MHC-I-opathy", Journal of Human Genetics, 2019, 65(3), pp. 325-335.

Babaie et al., "The roles of ERAP1 and ERAP2 in autoimmunity and cancer immunity: New insights and perspective", Molecular Immunology, 2020, 121, pp. 7-19.

Non-Final Office Action dated Aug. 22, 2024 in related U.S. Appl. No. 17/384,601.

Kato et al., "Molecular analysis of the serologically defined HLA-AW19 antigens, A genetically distinct family of HLA-A antigens comprising A29, A31, A32, and AW33, but probably not A30", The Journal of Immunology, 1989, 143(10), pp. 3371-3378.

Final Office Action dated Jan. 3, 2025 in related U.S. Appl. No. 17/384,601.

Advisory Action dated Mar. 17, 2025 in related U.S. Appl. No. 17/384,601.

* cited by examiner

| Second HLA-A Allele | UParis (A29 EUR Carriers) | | | GHS cohort #1 (A29 EUR) | | | GHS cohort #2 (A29 EUR) | | | UKB (A29 EUR) | | |
|---|---|---|---|---|---|---|---|---|---|---|---|---|
| | Cases n=286 | Ctrls n=108 | OR (LCI-UCI) | p-val | Carriers n=4014 | OR (LCI-UCI) | p-val | Carriers n=2829 | OR (LCI-UCI) | p-val | Carriers n=38,543 | OR (LCI-UCI) | p-val |
| Aw19 co-susceptible (29,30,31,33) | 41 | 4 | 4.44 (1.55-17.53) | 2.20E-03 | 247 | 2.63 (1.80-3.78) | 1.29E-06 | 184 | 2.69 (1.81-3.92) | 1.07E-06 | 2416 | 2.51 (1.75-3.52) | 9.62E-07 |
| A3002 | 13 | 1 | 5.19 (0.76-222.84) | 0.12 | 45 | 4.31 (2.11-8.26) | 6.15E-05 | 20 | 6.60 (2.98-14.13) | 3.03E-06 | 396 | 4.60 (2.39-8.09) | 1.25E-05 |
| A3301 | 9 | 0 | Inf (0.77-Inf) | 0.07 | 39 | 3.40 (1.43-7.23) | 3.20E-03 | 32 | 2.80 (1.16-6.09) | 0.01 | 255 | 4.89 (2.19-9.56) | 1.63E-04 |
| A0301 | 26 | 15 | 0.63 (0.31-1.35) | 0.20 | 592 | 0.59 (0.38-0.90) | 0.01 | 380 | 0.63 (0.40-0.97) | 0.03 | 5497 | 0.60 (0.38-0.90) | 0.01 |
| A0101 | 71 | 17 | 1.81 (0.99-3.48) | 0.04 | 662 | 1.73 (1.29-2.31) | 2.67E-04 | 448 | 1.74 (1.28-2.33) | 3.21E-04 | 7411 | 1.39 (1.05-1.83) | 0.02 |
| A3201 | 3 | 4 | 0.28 (0.04-1.70) | 0.10 | 152 | 0.38 (0.06-3.83) | 0.01 | 105 | 0.37 (0.05-0.82) | 0.02 | 1323 | 0.30 (0.06-0.80) | 0.02 |
| A0201 | 64 | 24 | 1.03 (0.59-1.85) | 1.00 | 1085 | 0.80 (0.59-1.08) | 0.14 | 756 | 0.78 (0.57-1.04) | 0.09 | 10680 | 0.75 (0.56-1.00) | 0.05 |
| A2302 | 10 | 1 | 3.95 (0.55-173.12) | 0.30 | 48 | 3.07 (1.37-6.24) | 3.65E-03 | 37 | 2.70 (1.18-5.61) | 9.43E-03 | 750 | 1.83 (0.86-3.43) | 0.08 |
| A2601 | 8 | 3 | 1.03 (0.24-6.13) | 1.00 | 115 | 1.00 (0.42-2.07) | 1.00 | 91 | 0.85 (0.35-1.78) | 0.86 | 834 | 1.30 (0.55-2.62) | 0.41 |
| A2501 | 3 | 2 | 0.57 (0.06-6.96) | 0.62 | 101 | 0.42 (0.08-1.28) | 0.16 | 47 | 0.62 (0.12-1.94) | 0.62 | 673 | 0.60 (0.12-1.77) | 0.50 |
| A2402 | 23 | 11 | 0.79 (0.35-1.86) | 0.55 | 356 | 0.92 (0.57-1.44) | 0.83 | 249 | 0.89 (0.55-1.40) | 0.74 | 2801 | 1.12 (0.69-1.72) | 0.57 |
| A3101 | 9 | 2 | 1.75 (0.35-16.85) | 0.73 | 115 | 1.13 (0.50-2.26) | 0.71 | 75 | 1.18 (0.51-2.39) | 0.57 | 1015 | 1.20 (0.54-2.33) | 0.58 |
| A1101 | 14 | 10 | 0.52 (0.21-1.34) | 0.16 | 255 | 0.78 (0.41-1.36) | 0.44 | 177 | 0.76 (0.40-1.33) | 0.44 | 2278 | 0.82 (0.44-1.40) | 0.61 |
| A2301 | 6 | 2 | 1.16 (0.20-11.91) | 1.00 | 94 | 0.92 (0.33-2.10) | 1.00 | 61 | 0.96 (0.34-2.24) | 1.00 | 672 | 1.21 (0.44-2.68) | 0.65 |
| A6801 | 9 | 8 | 0.42 (0.14-1.27) | 0.09 | 128 | 1.01 (0.45-2.01) | 0.86 | 100 | 0.87 (0.38-1.76) | 0.87 | 1142 | 1.07 (0.48-2.06) | 0.86 |
| A19 all (29,30,31,32,33) | 44 | 8 | 2.07 (0.92-4.64) | 0.08 | 399 | 1.49 (1.02-2.18) | 0.04 | 269 | 1.58 (1.07-2.34) | 0.02 | 3739 | 1.51 (1.04-2.18) | 0.03 |

Figure 1

| Second HLA-A Allele | UParis (A29 EUR Carriers) | | | | GHS cohort #1 (A29 EUR) | | | GHS cohort #2 (A29 EUR) | | | UKB* (A29 EUR) | | |
|---|---|---|---|---|---|---|---|---|---|---|---|---|---|
| | Cases n=286 | Ctrls n=108 | OR (LCI-UCI) | p-val | Carriers n=4014 | OR (LCI-UCI) | p-val | Carriers n=2829 | OR (LCI-UCI) | p-val | Carriers n=38,543 | OR (LCI-UCI) | p-val |
| A19 co-susceptible (29,30,31,33) | 41 | 4 | 4.05 (1.40-11.77) | 0.01 | 247 | 2.21 (1.47-3.33) | 1.55E-04 | 164 | 2.49 (1.63-3.81) | 2.34E-05 | 2416 | 2.24 (1.52-3.30) | 4.57E-05 |
| A3002 | 13 | 1 | 4.32 (0.55-33.79) | 0.16 | 45 | 2.78 (1.31-5.88) | 7.66E-03 | 20 | 4.26 (1.83-9.92) | 7.68E-04 | 396 | 4.01 (2.05-7.84) | 4.99E-05 |
| A3301 | 9 | 0 | 6204540.00 (0.00-inf) | 0.98 | 39 | 3.12 (1.29-7.58) | 0.01 | 32 | 2.69 (1.15-6.28) | 0.02 | 255 | 2.00 (0.80-5.01) | 0.14 |
| A0301 | 26 | 15 | 0.71 (0.35-1.45) | 0.35 | 592 | 0.69 (0.45-1.08) | 0.11 | 380 | 0.72 (0.46-1.14) | 0.16 | 5497 | 0.65 (0.43-1.01) | 0.05 |
| A0101 | 71 | 17 | 1.84 (1.01-3.35) | 0.05 | 662 | 1.57 (1.15-2.16) | 0.00 | 448 | 1.59 (1.15-2.19) | 0.01 | 7411 | 1.82 (1.35-2.45) | 0.00 |
| A3201 | 3 | 4 | 0.22 (0.05-1.04) | 0.05 | 152 | 0.30 (0.09-0.97) | 4.39E-02 | 105 | 0.22 (0.08-0.63) | 2.52E-02 | 1323 | 0.28 (0.08-0.90) | 3.33E-02 |
| A0201 | 64 | 24 | 0.97 (0.56-1.68) | 0.92 | 1085 | 0.87 (0.64-1.20) | 0.41 | 756 | 0.87 (0.63-1.20) | 0.41 | 10680 | 0.82 (0.61-1.11) | 0.20 |
| A2902 | 10 | 1 | 3.26 (0.40-26.32) | 0.27 | 48 | 1.63 (0.80-4.28) | 0.15 | 37 | 1.94 (0.84-4.46) | 0.12 | 750 | 2.10 (1.03-4.23) | 0.04 |
| A2601 | 8 | 3 | 1.09 (0.28-4.26) | 0.90 | 115 | 0.87 (0.39-1.91) | 0.72 | 91 | 0.91 (0.40-2.09) | 0.82 | 834 | 0.73 (0.33-1.61) | 0.44 |
| A2501 | 3 | 2 | 0.55 (0.08-3.61) | 0.54 | 101 | 0.57 (0.16-2.01) | 0.38 | 47 | 0.69 (0.18-2.62) | 0.59 | 673 | 0.66 (0.20-2.15) | 0.49 |
| A2402 | 23 | 11 | 0.85 (0.39-1.85) | 0.67 | 356 | 0.99 (0.61-1.61) | 0.97 | 249 | 1.06 (0.65-1.74) | 0.81 | 2801 | 1.00 (0.63-1.59) | 0.99 |
| A3101 | 9 | 2 | 1.75 (0.37-8.33) | 0.48 | 115 | 1.42 (0.68-2.97) | 0.35 | 75 | 1.57 (0.72-3.41) | 0.25 | 1015 | 1.24 (0.58-2.64) | 0.57 |
| A1101 | 14 | 10 | 0.55 (0.23-1.34) | 0.19 | 255 | 0.81 (0.45-1.48) | 0.50 | 177 | 0.83 (0.45-1.53) | 0.54 | 2278 | 0.82 (0.46-1.45) | 0.49 |
| A2301 | 6 | 2 | 1.06 (0.21-5.47) | 0.94 | 94 | 0.85 (0.34-2.17) | 0.74 | 61 | 0.73 (0.28-1.95) | 0.53 | 672 | 0.85 (0.35-2.10) | 0.73 |
| A6801 | 9 | 8 | 0.42 (0.16-1.15) | 0.09 | 128 | 0.95 (0.45-2.04) | 0.90 | 100 | 0.76 (0.35-1.67) | 0.50 | 1142 | 1.43 (0.70-2.91) | 0.33 |
| A19 all (29,30,31,32,33) | 44 | 8 | 2.07 (0.92-4.64) | 0.08 | 399 | 1.49 (1.02-2.18) | 0.04 | 269 | 1.58 (1.07-2.34) | 0.02 | 3739 | 1.51 (1.04-2.18) | 0.03 |

Figure 3

| Gene | Variant | Variant type | Study | OR (LCI-UCI) | p-value | Hom OR | Case MAF | Control MAF | Meta OR (LCI-UCI) | Meta p-value |
|---|---|---|---|---|---|---|---|---|---|---|
| ERAP2-LNPEP | rs10044354 5:96984791:C:T | Intronic | Kuiper et al. | 2.3 (1.69-3.61) | 1.21E-06 | | 0.63 | 0.42 | 1.95 (1.55-2.44) | 6.20E-09 |
| | | | UParis | 1.55 (1.13-2.11) | 5.80E-03 | 2.6 (1.3-5.15) | 0.52 | 0.41 | | |

Figure 4

| Gene | Variant | Variant type | Study | OR (LCI-UCI) | p-value | Hom OR | Case MAF | Control MAF | Meta OR (LCI-UCI) | Meta p-value |
|---|---|---|---|---|---|---|---|---|---|---|
| ERAP2 | rs2248374 5:96900192:A:G | Splice region | Kuiper et al. | 0.44 (0.31-0.63) | 6.60E-06 | | 0.33 | 0.53 | 0.56 (0.45-0.70) | 2.39E-07 |
| | | | UParis | 0.68 (0.5-0.92) | 1.40E-02 | 0.45 (0.23-0.87) | 0.43 | 0.53 | | |

Figure 5

| Aw19 | ERAP2-rs10044354 | case_n | contr_n | case_F | controlF | OR | OR CI_low | OR CI_high | P |
|---|---|---|---|---|---|---|---|---|---|
| A29/- | CC | 46 | 1296 | 0.167 | 0.319 | 1.000 | NA | NA | NA |
| A29/- | CT | 132 | 1842 | 0.478 | 0.453 | 2.019 | 1.421 | 2.911 | 3.95E-05 |
| A29/- | TT | 56 | 681 | 0.203 | 0.167 | 2.316 | 1.522 | 3.539 | 4.51E-05 |
| A29/Aw19 | CC | 13 | 94 | 0.047 | 0.023 | 3.891 | 1.861 | 7.644 | 2.13E-04 |
| A29/Aw19 | CT | 17 | 119 | 0.062 | 0.029 | 4.019 | 2.092 | 7.413 | 2.32E-05 |
| A29/Aw19 | TT | 12 | 34 | 0.043 | 0.008 | 9.902 | 4.378 | 21.197 | 1.16E-07 |

Figure 7

| Allele\position | 9 | 17 | 56 | 62 | 63 | 70 | 73 | 76 | 77 | 79 | 80 | 81 | 82 | 83 | 97 | 105 | 109 | 114 | 116 | 152 |
|---|---|---|---|---|---|---|---|---|---|---|---|---|---|---|---|---|---|---|---|---|
| A*01:01:01:01 | F | R | G | Q | E | H | T | A | N | G | T | L | R | G | I | P | F | R | D | A |
| A*29:02:01:01 | T | S | . | L | Q | Q | . | E | . | . | . | . | . | . | M | S | . | E | H | V |
| A*30:02:01:01 | S | . | R | . | . | . | . | V | D | . | . | . | . | . | . | S | . | Q | . | R |
| A*31:01:02:01 | T | . | R | . | . | . | I | E | S | . | . | . | . | . | M | S | . | Q | . | V |
| A*32:01:01:01 | . | . | . | R | N | . | I | V | D | R | . | A | L | R | M | . | . | Q | . | V |
| A*33:01:01:01 | T | . | . | . | . | . | . | V | D | . | . | . | . | . | M | S | L | Q | . | V |
| A*74:01:01:01 | . | . | . | . | . | . | . | V | D | . | . | . | L | . | M | . | L | Q | . | V |

Figure 8

MATERIALS AND METHODS OF TREATING MHC-I-OPATHY RISK HAPLOTYPES

REFERENCE TO SEQUENCE LISTING

This application includes a Sequence Listing filed electronically as a text file named 18923810701SEQ, created on Apr. 6, 2022, with a size of 1027 kilobytes. The Sequence Listing is incorporated herein by reference.

FIELD

The present disclosure is directed, in part, to methods of treating subjects having an immune disorder by administering to the subject a therapeutically effective amount of an Endoplasmic Reticulum Aminopeptidase 2 (ERAP2) inhibitor in combination with an HLA-A29 or HLA-B27 inhibitory nucleic acid molecule.

BACKGROUND

The cellular immune response in humans relies at least partly on the presentation of small peptides that are 8 to 10 amino acids long, which are bound proteins of the major histocompatibility complex (MHC) (i.e., class I MHC molecules). These small peptides are derived from the proteolytic degradation of proteins (foreign antigens and self-antigens). One source of these antigens come from infected or malignantly transformed cells that express particular protein molecules that, upon degradation, yield distinct antigenic peptides that are presented on the cell surface complexed with MHC class I molecules (MHCI). Cytotoxic T cells can recognize these complexes of MHC molecules with degraded protein antigens and induce apoptotic cell death. Aberrant generation of antigenic peptides can lead to immune system evasion or to autoimmune reactions.

Although most antigenic peptides are initially produced by the proteasome, many of them are larger than the final antigenic epitope and contain one or more additional amino acids at their N-termini. These antigenic peptide precursors are transported into the endoplasmic reticulum (ER), where they are further degraded by at least two different aminopeptidases, ERAP1 and ERAP2, to generate the mature antigenic peptides for complexing with MHC class I molecules. Thus, the activity of ERAP1 and ERAP2 can directly affect the presentation of antigenic peptides complexed with particular MHC molecules in a beneficial or adverse manner, thus altering the immune response. Accordingly, there continues to be a need for identifying subjects that have particular MHC-I-opathies related to ERAP2 activity and treatment of the same.

Birdshot Chorioretinopathy (BSCR) is a rare autoimmune uveitis predominately affecting individuals over the age of 50 of European descent and treated with immunomodulatory therapies. The disease presents with vitritis and gradual decline in vision due to choroidal and retinal inflammatory lesions and atrophy. T cells have been identified in the retinal and choroidal tissues as well as the vitreous of affected BSCR eyes.

SUMMARY

The present disclosure provides methods of treating a subject having an immune disorder, the methods comprising administering to the subject an ERAP2 inhibitor and: i) an HLA-A29 inhibitor and/or ii) an HLA-B27 inhibitor.

The present disclosure provides methods of treating a subject having an MHC-I-opathy, the methods comprising: performing or having performed an assay on a biological sample from the subject to determine whether the subject comprises: i) an HLA-A29 allele and/or an HLA-B27 allele; and ii) a functional ERAP2 protein or a nucleic acid molecule encoding a functional ERAP2 protein; and administering to the subject a therapeutically effective amount of an ERAP2 inhibitor and an HLA-A29 inhibitor to the subject having the functional ERAP2 protein or the nucleic acid molecule encoding a functional ERAP2 protein, and having the HLA-A29 allele; or administering to the subject a therapeutically effective amount of an ERAP2 inhibitor and an HLA-B27 inhibitor to the subject having the functional ERAP2 protein or the nucleic acid molecule encoding a functional ERAP2 protein, and having the HLA-B27 allele; wherein the presence of both: i) the HLA-A29 allele and/or the HLA-B27 allele, and ii) the functional ERAP2 protein or the nucleic acid molecule encoding a functional ERAP2 protein, indicates that the subject is a candidate for treating the MHC-I-opathy by inhibiting ERAP2.

The present disclosure provides combinations of an ERAP2 inhibitor and an HLA-A29 inhibitor for use in the treatment of an immune disorder.

The present disclosure provides combinations of an ERAP2 inhibitor and an HLA-B27 inhibitor for use in the treatment of an immune disorder.

BRIEF DESCRIPTION OF THE DRAWINGS

FIG. 1 shows a table of HLA-A 2nd allele frequencies in the French cohort compared to UKB and GHS EUR A29 carriers. Alleles belonging to the Aw19 broad antigen group that increase risk are A29 (eighth row), A30 (second row), A31 (twelfth row) and A33 (third row) and A32 exhibits protection (third row). A Fisher's exact test combining all Aw19 risk alleles presents the strongest enrichment in all comparisons (first row). Only alleles that have three or more case carriers are presented. Table is sorted by p-values when comparing case frequencies against A29 controls in UKB.

FIG. 3 shows a table of HLA-A 2nd allele frequencies in the French cohort compared to UKB and GHS EUR A29 carriers. Alleles belonging to the Aw19 broad antigen group that increase risk are A29 (eighth row), A30 (second row), A31 (twelfth row) and A33 (third row) and A32 exhibits protection (sixth row). A logistic regression test with covariates included for sex and six principal components, calculated based on genetic array data for each analytic set. Results are presented for all HLA-A alleles that have three or more case carriers. Alleles are sorted as in FIG. 1. * Three principal components.

FIG. 4 shows a table of top SNPs in ERAP2 regions. Variants in ERAP2 are genome-wide significant when analyzed together with previous results (125 cases and 670 controls (Kuiper 2014). Rs10044354 is the top association in the ERAP1-ERAP2 locus in the previous GWAS of Dutch and Spanish cohorts, while rs27432 is the top association in the region in the current French cohort. The LD between the two loci is also presented. *The reference A-allele is the minor allele, risk is the G-allele.

FIG. 5 shows ERAP2 splice region variant is protective for BSCR. The common ERAP2 splice region variant rs2248374 that disrupts ERAP2 expression is protective in the current BSCR cohort and the previous Spanish and Dutch cohorts.

FIG. 7 shows a table of the combined risk of ERAP2 and Aw19. Utilizing 286 Birdshot cases and 4,014 controls from GHS cohort #1 to calculate additive risk while combining risk factors in ERAP2 and Aw19. An additive genotype model of ERAP2 risk signal tagged by rs10044354 and single (A29/-) or double (A29/Aw19) Aw19 copies relative to lowest risk combination of rs10044354-CC and one copy of Aw19 allele (A29).

FIG. 8 shows differences between risk Aw19 alleles and A32. Sequence differences between risk Aw19 alleles (second, third, fourth, and sixth rows) and protective A32 allele (fifth row). A32 exhibits F at position 9 as is the reference A:01:01 allele, while risk alleles are either T or S at that position. The Bw4 epitope sequence is apparent at positions 79-83 or A32 only. The risk allele at position 17 is S; the risk alleles at position 62 are L or R; the risk alleles at position 63 are Q or N; the risk allele at position 70 is Q; the risk allele at position 73 is I; the risk allele at position 105 is S; the risk allele at position 116 is H; and the risk allele at position 152 is R.

DESCRIPTION OF EMBODIMENTS

Figure 2:
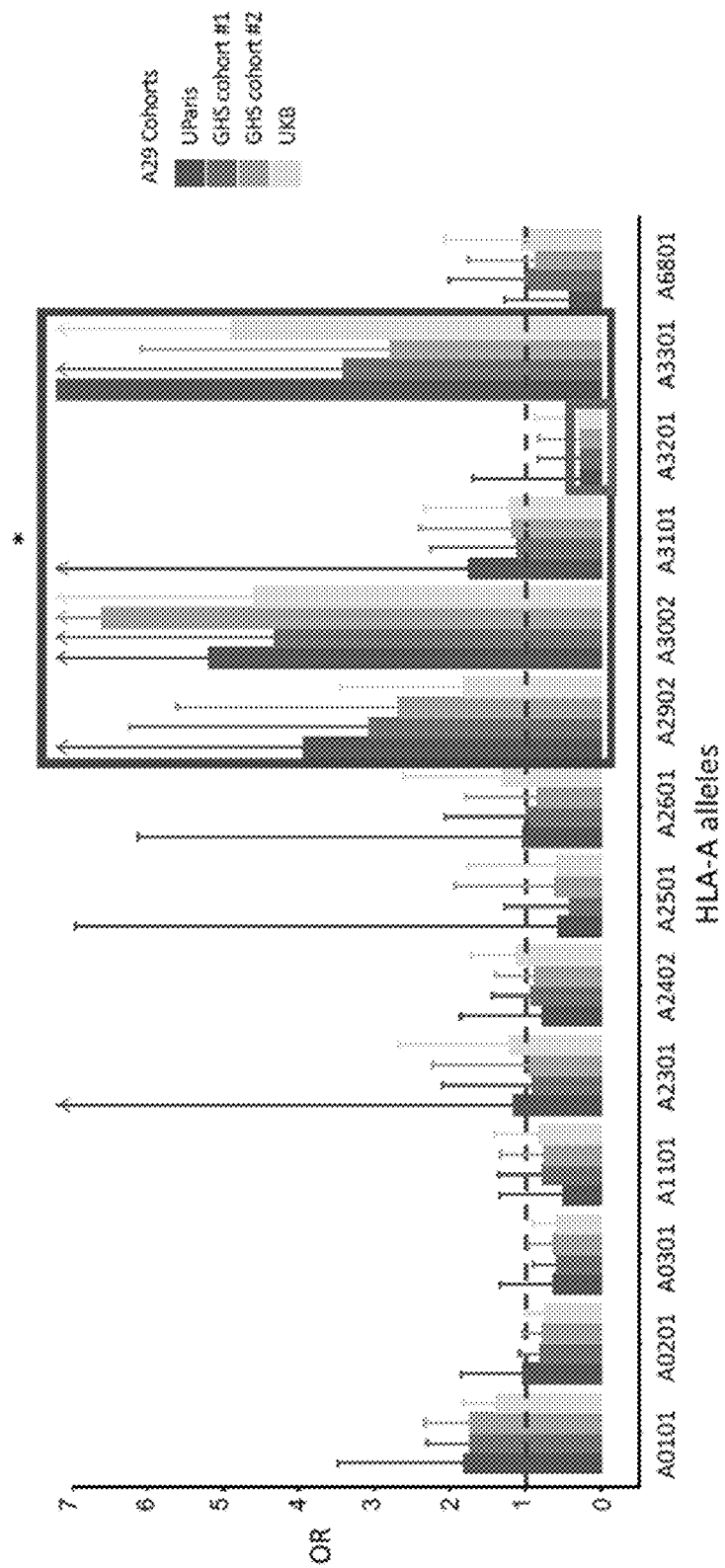
FIG. 2 shows Aw19 enrichment in Birdshot cases. Odds-ratio for BSCR, comparing frequencies of 14 HLA-A alleles that are present in three or more cases (>1%, x-axis) in 286 UParis cases compared with 108 UParis controls, GHS control cohort #1 (n=4,014), GHS control cohort #2 (n=2,829) and UKB controls 38,543). Aw19 alleles show the highest ORs (large box) that replicates with large A29 control cohorts, with the exception of A32 that is depleted in cases (small box). * $p<0.01$

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates (such as, for example, apes and monkeys). In some embodiments, the subject is a human. In some embodiments, the subject is a patient under the care of a physician.

The present disclosure provides methods of treating a subject having an immune disorder, the methods comprising administering to the subject an ERAP2 inhibitor. In some embodiments, the immune disorder is an MHC-I-opathy. In some embodiments, the immune disorder is an MHC-II-opathy. In some embodiments, the MHC-I-opathy is Birdshot Chorioretinopathy (BSCR), Ankylosing Spondylitis (AS), psoriasis in combination with uveitis, or Juvenile Idiopathic Arthritis (JIA). In some embodiments, the MHC-I-opathy is BSCR. In some embodiments, the MHC-I-opathy is AS. In some embodiments, the MHC-I-opathy is psoriasis in combination with uveitis. In some embodiments, the MHC-I-opathy is JIA.

In some embodiments, the MHC-I-opathy is BSCR. In some embodiments, the method further comprises detecting the presence or absence of an HLA-Aw19 allele in a biological sample obtained from the subject. In some embodiments, the subject is HLA-Aw19$^+$. In some embodiments, the subject is or is suspected of being HLA-A29$^+$, HLA-A30$^+$, HLA-A31$^+$, or HLA-A33$^+$, or any combination thereof. In some embodiments, the method further comprises determining whether the subject has one or two copies of an HLA-Aw19 allele. In some embodiments, the subject has a single copy of HLA-Aw19. In some embodiments, the subject has two copies of HLA-Aw19. In some embodiments, the subject is HLA-A29$^+$/HLA-A30$^+$. In some embodiments, the subject is HLA-A29$^+$/HLA-A31$^+$. In some embodiments, the subject is HLA-A29$^+$/HLA-A33$^+$.

In some embodiments, the subject having BSCR is not HLA-A29$^+$.

In some embodiments, the subject having BSCR has a copy of at least any two of HLA-A29, HLA-A30, HLA-A31, or HLA-A33. In some embodiments, the subject having BSCR has a copy of at least any three of HLA-A29, HLA-A30, HLA-A31, or HLA-A33. In some embodiments, the subject having BSCR has a copy of all of HLA-A29, HLA-A30, HLA-A31, or HLA-A33.

In some embodiments, the subject having BSCR has one copy of each HLA-A29 and HLA-A30. In some embodiments, the subject having BSCR has one copy of each HLA-A29 and HLA-A31. In some embodiments, the subject having BSCR has one copy of each HLA-A29 and HLA-A33. In some embodiments, the subject having BSCR has one copy of each HLA-A30 and HLA-A31. In some embodiments, the subject having BSCR has one copy of each HLA-A30 and HLA-A33. In some embodiments, the subject having BSCR has one copy of each HLA-A31 and HLA-A33.

In some embodiments, the subject having BSCR has one copy of HLA-A29 and two copies of HLA-A30. In some embodiments, the subject having BSCR has one copy of HLA-A29 and two copies of HLA-A31. In some embodiments, the subject having BSCR has one copy of HLA-A29 and two copies of HLA-A33. In some embodiments, the subject having BSCR has one copy of HLA-A30 and two copies of HLA-A31. In some embodiments, the subject having BSCR has one copy of HLA-A30 and two copies HLA-A33. In some embodiments, the subject having BSCR has one copy of HLA-A31 and two copies of HLA-A33.

In some embodiments, the subject having BSCR has two copies of HLA-A29 and one copy of HLA-A30. In some embodiments, the subject having BSCR has two copies of HLA-A29 and one copy of HLA-A31. In some embodiments, the subject having BSCR has two copies of HLA-A29 and one copy of HLA-A33. In some embodiments, the subject having BSCR has two copies of HLA-A30 and one copy of HLA-A31. In some embodiments, the subject having BSCR has two copies of HLA-A30 and one copy of HLA-A33. In some embodiments, the subject having BSCR has two copies of HLA-A31 and one copy of HLA-A33.

In some embodiments, the subject having BSCR or suspected of having BSCR has two copies of HLA-A29 and two copies of HLA-A30. In some embodiments, the subject having BSCR or suspected of having BSCR has two copies of HLA-A29 and two copies of HLA-A31. In some embodiments, the subject having BSCR or suspected of having BSCR has two copies of HLA-A29 and two copies of HLA-A33. In some embodiments, the subject having BSCR or suspected of having BSCR has two copies of HLA-A30 and two copies of HLA-A31. In some embodiments, the subject having BSCR or suspected of having BSCR has two copies of HLA-A30 and two copies of HLA-A33. In some embodiments, the subject having BSCR or suspected of having BSCR has two copies of HLA-A31 and two copies of HLA-A33.

In some embodiments, the method further comprises administering to the subject an HLA-Aw19 inhibitor. In some embodiments, the HLA-Aw19 inhibitor comprises an antibody. In some embodiments, the antibody comprises an anti-HLA-A29 antibody. In some embodiments, the HLA-Aw19 inhibitor comprises a small molecule degrader or an inhibitory nucleic acid molecule. In some embodiments, the inhibitory nucleic acid molecule comprises an antisense nucleic acid molecule, a small interfering RNA (siRNA), or a short hairpin RNA (shRNA) that hybridizes to an HLA-Aw19. In some embodiments, the HLA-Aw19 is HLA-A29.

In some embodiments, the MHC-I-opathy is AS. In some embodiments, the method further comprises detecting the presence or absence of HLA-B27 or HLA-B40 in a biological sample obtained from the subject. In some embodiments, the subject is or is suspected of being HLA-B27$^+$. In some embodiments, the subject is or is suspected of being HLA-B40$^+$. In some embodiments, the method further comprises determining whether the subject has one or two copies of HLA-B27 or HLA-B40. In some embodiments, the subject has a single copy of HLA-B27 or HLA-B40. In some embodiments, the subject has two copies of HLA-B27 or HLA-B40. In some embodiments, the method further comprises administering to the subject an HLA-B27 inhibitor or an HLA-B40 inhibitor. In some embodiments, the HLA-B27 inhibitor or HLA-B40 inhibitor comprises an antibody. In some embodiments, the antibody comprises an anti-HLA-B27 antibody or an anti-HLA-B40 antibody. In some embodiments, the HLA-B27 inhibitor or HLA-B40 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27 or an HLA-B40.

In some embodiments, the MHC-I-opathy is psoriasis in combination with uveitis. In some embodiments, the uveitis is anterior uveitis. In some embodiments, the method further comprises detecting the presence or absence of HLA-B27 in a biological sample obtained from the subject. In some embodiments, the subject is or is suspected of being HLA-B27$^+$. In some embodiments, the method further comprises determining whether the subject has one or two copies of HLA-B27. In some embodiments, the subject has a single copy of HLA-B27. In some embodiments, the subject has two copies of HLA-B27. In some embodiments, the method further comprises administering to the subject an HLA-B27 inhibitor. In some embodiments, the HLA-B27 inhibitor comprises an antibody. In some embodiments, the antibody comprises an anti-HLA-B27 antibody. In some embodiments, the HLA-B27 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27.

In some embodiments, the MHC-I-opathy is JIA. In some embodiments, the method further comprises detecting the presence or absence of HLA-B27 and/or DRB1 in a biological sample obtained from the subject. In some embodiments, the subject is or is suspected of being HLA-B27$^+$ and/or DRB1$^+$. In some embodiments, the method further comprises determining whether the subject has one or two copies of HLA-B27 and/or DRB1. In some embodiments, the subject has a single copy of HLA-B27 and/or DRB1. In some embodiments, the subject has two copies of HLA-B27 and/or DRB1. In some embodiments, the method further comprises administering to the subject an HLA-B27 inhibitor and/or a DRB1 inhibitor. In some embodiments, the HLA-B27 inhibitor and/or DRB1 inhibitor comprises an antibody. In some embodiments, the antibody comprises an anti-HLA-B27 antibody or an anti-DRB1 antibody. In some embodiments, the HLA-B27 inhibitor and/or DRB1 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27 and/or an DRB1.

In some embodiments, the ERAP2 inhibitor comprises a small molecule degrader, a proteoloysis-targeting chimera, an immunomodulatory drug, or an inhibitory nucleic acid molecule. In some embodiments, the inhibitory nucleic acid molecule comprises an antisense nucleic acid molecule, an siRNA, or an shRNA that hybridizes to ERAP2 mRNA. In some embodiments, the inhibitory nucleic acid molecule comprises an antisense nucleic acid molecule that hybridizes to ERAP2 mRNA. In some embodiments, the inhibitory nucleic acid molecule comprises an siRNA that hybridizes to ERAP2 mRNA. In some embodiments, the inhibitory nucleic acid molecule comprises an shRNA that hybridizes to ERAP2 mRNA. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013 (see, for example, Zervoudi et al., Proc. Natl. Acad. Sci. USA, 2013, 110, 19890-19895). In some embodiments, the phosphinic pseudopeptide is DG002. In some embodiments, the phosphinic pseudopeptide is DG013. In some embodiments, the ERAP2 inhibitor comprises a small molecule. In some embodiments, the ERAP2 inhibitor is compound 4, compound 15, compound 16, compound 5, or analogues of compound 5, which are drug-like carboxylic acids and bioisosters screened for enhanced selectivity for ERAP2 over ERAP1 (see, Medve et al., European Journal of Medicinal Chemistry, 2021, 211, 113053). In some embodiments, the ERAP2 inhibitor is a phosphonic or phosphinic acid compound with higher affinity for ERAP2 than ERAP1 (see, Weglarz-Tomczak et al., Bioorg. Med. Chem. Lett., 2016, 26, 4122-4126). Additional ERAP2 inhibitors are described in, for example, Georgiadis et al., Curr. Medic. Chem., 2019, 26, 2715-2729.

In any of the embodiments described herein, any of the inhibitors or other agents described herein can form a component of an antibody-drug-conjugate (ADC). For example, an ERAP2 inhibitor can be conjugated to an antibody, or antigen-binding fragment thereof. The inhibitor can comprise a small molecule degrader, a proteoloysis-targeting chimera, an immunomodulatory drug, or an inhibitory nucleic acid molecule.

The present disclosure also provides methods of treating a subject having an MHC-1-opathy. In some embodiments, the method comprises performing or having performed an assay on a biological sample from the subject to determine whether the subject comprises: i) an MHC-I-opathy-related HLA genotype; and ii) a functional ERAP2 protein or a nucleic acid molecule encoding a functional ERAP2 protein. In some embodiments, the method comprises administering to the subject a therapeutically effective amount of an ERAP2 inhibitor, wherein the subject comprises both an MHC-I-opathy-related HLA genotype and a functional ERAP2 protein or a nucleic acid molecule encoding a functional ERAP2 protein. The presence of both the MHC-I-opathy-related HLA genotype and the functional ERAP2 protein or a nucleic acid molecule encoding a functional ERAP2 protein indicates that the subject is a candidate for treating the MHC-I-opathy by inhibiting ERAP2.

In some embodiments, the MHC-I-opathy is BSCR and the MHC-I-opathy-related HLA genotype comprises an HLA-Aw19 allele. In some embodiments, the HLA-Aw19 allele comprises an HLA-A29 allele, an HLA-A30 allele, an HLA-A31 allele, or an HLA-A33 allele, or any combination thereof. In some embodiments, the subject has a single copy of the HLA-Aw19 allele. In some embodiments, the HLA-Aw19 allele comprises an HLA-A29 allele. In some embodiments, the HLA-Aw19 allele comprises an HLA-A30 allele. In some embodiments, the HLA-Aw19 allele comprises an HLA-A31 allele. In some embodiments, the HLA-Aw19 allele comprises an HLA-A33 allele. In some embodiments, the subject has two copies of the HLA-Aw19 allele. In some embodiments, the subject is or is suspected of being HLA-A29$^+$/HLA-A30$^+$. In some embodiments, the subject is or is suspected of being HLA-A29$^+$/HLA-A31$^+$. In some embodiments, the subject is or is suspected of being HLA-A29$^+$/HLA-A33$^+$.

In some embodiments, the subject having BSCR is not HLA-A29$^+$.

In some embodiments, the subject having BSCR has a copy of at least any two of HLA-A29, HLA-A30, HLA-A31, or HLA-A33. In some embodiments, the subject having BSCR has a copy of at least any three of HLA-A29, HLA-A30, HLA-A31, or HLA-A33. In some embodiments, the subject having BSCR has a copy of all of HLA-A29, HLA-A30, HLA-A31, or HLA-A33.

In some embodiments, the subject having BSCR has one copy of each HLA-A29 and HLA-A30. In some embodiments, the subject having BSCR has one copy of each HLA-A29 and HLA-A31. In some embodiments, the subject having BSCR has one copy of each HLA-A29 and HLA-A33. In some embodiments, the subject having BSCR has one copy of each HLA-A30 and HLA-A31. In some embodiments, the subject having BSCR has one copy of each HLA-A30 and HLA-A33. In some embodiments, the subject having BSCR has one copy of each HLA-A31 and HLA-A33.

In some embodiments, the subject having BSCR has one copy of HLA-A29 and two copies of HLA-A30. In some embodiments, the subject having BSCR has one copy of HLA-A29 and two copies of HLA-A31. In some embodiments, the subject having BSCR has one copy of HLA-A29 and two copies of HLA-A33. In some embodiments, the subject having BSCR has one copy of HLA-A30 and two copies of HLA-A31. In some embodiments, the subject having BSCR has one copy of HLA-A30 and two copies HLA-A33. In some embodiments, the subject having BSCR has one copy of HLA-A31 and two copies of HLA-A33.

In some embodiments, the subject having BSCR has two copies of HLA-A29 and one copy of HLA-A30. In some embodiments, the subject having BSCR has two copies of HLA-A29 and one copy of HLA-A31. In some embodiments, the subject having BSCR has two copies of HLA-A29 and one copy of HLA-A33. In some embodiments, the subject having BSCR has two copies of HLA-A30 and one copy of HLA-A31. In some embodiments, the subject having BSCR has two copies of HLA-A30 and one copy of HLA-A33. In some embodiments, the subject having BSCR has two copies of HLA-A31 and one copy of HLA-A33.

In some embodiments, the subject having BSCR or suspected of having BSCR has two copies of HLA-A29 and two copies of HLA-A30. In some embodiments, the subject having BSCR or suspected of having BSCR has two copies of HLA-A29 and two copies of HLA-A31. In some embodiments, the subject having BSCR or suspected of having BSCR has two copies of HLA-A29 and two copies of HLA-A33. In some embodiments, the subject having BSCR or suspected of having BSCR has two copies of HLA-A30 and two copies of HLA-A31. In some embodiments, the subject having BSCR or suspected of having BSCR has two copies of HLA-A30 and two copies of HLA-A33. In some embodiments, the subject having BSCR or suspected of having BSCR has two copies of HLA-A31 and two copies of HLA-A33.

In some embodiments, the method further comprises administering to the subject an HLA-Aw19 inhibitor. In some embodiments, the HLA-Aw19 inhibitor comprises an antibody. In some embodiments, the antibody comprises an anti-HLA-A29 antibody. In some embodiments, the HLA-Aw19 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-Aw19. In some embodiments, the HLA-Aw19 is HLA-A29.

In some embodiments, the MHC-I-opathy is AS and the MHC-I-opathy-related HLA genotype comprises an HLA-B27 allele or an HLA-B40 allele. In some embodiments, the subject has a single copy of HLA-B27 or HLA-B40. In some embodiments, the subject has two copies of HLA-B27 or HLA-B40. In some embodiments, the method further comprises administering to the subject an HLA-B27 inhibitor or an HLA-B40 inhibitor. In some embodiments, the HLA-B27 inhibitor or HLA-B40 inhibitor comprises an antibody. In some embodiments, the antibody comprises an anti-HLA- B27 antibody or an anti-HLA-B40 antibody. In some embodiments, the HLA-B27 inhibitor or HLA-B40 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27 or an HLA-B40.

In some embodiments, the MHC-I-opathy is psoriasis in combination with uveitis and the MHC-I-opathy-related HLA genotype comprises an HLA-B27 allele. In some embodiments, the uveitis is anterior uveitis. In some embodiments, the subject has a single copy of HLA-B27. In some embodiments, the subject has two copies of HLA-B27. In some embodiments, the method further comprises administering to the subject an HLA-B27 inhibitor. In some embodiments, the HLA-B27 inhibitor comprises an antibody. In some embodiments, the antibody comprises an anti-HLA-B27 antibody. In some embodiments, the HLA-B27 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27.

In some embodiments, the MHC-I-opathy is JIA and the MHC-I-opathy-related HLA genotype comprises an HLA-B27 and/or DRB1. In some embodiments, the subject has a single copy of HLA-B27 and/or DRB1. In some embodiments, the subject has two copies of HLA-B27 and/or. In some embodiments, the method further comprises administering to the subject an HLA-B27 inhibitor and/or a DRB1 inhibitor. In some embodiments, the HLA-B27 inhibitor and/or DRB1 inhibitor comprises an antibody. In some embodiments, the antibody comprises an anti-HLA-B27 antibody and/or a DRB1 antibody. In some embodiments, the HLA-B27 inhibitor and/or DRB1 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27 or DRB1.

In any of the embodiments described herein, the nucleic acid molecule comprises genomic DNA, mRNA, or cDNA obtained from mRNA. In some embodiments, the nucleic acid molecule comprises genomic DNA. In some embodiments, the nucleic acid molecule comprises mRNA. In some embodiments, the nucleic acid molecule comprises cDNA obtained from mRNA.

In any of the embodiments described herein, the ERAP2 inhibitor comprises a small molecule degrader, a proteoloysis-targeting chimera, an immunomodulatory drug, or an inhibitory nucleic acid molecule. In some embodiments, the inhibitory nucleic acid molecule comprises an antisense nucleic acid molecule, an siRNA, or an shRNA that hybridizes to ERAP2 mRNA. In some embodiments, the inhibitory nucleic acid molecule comprises an antisense nucleic acid molecule that hybridizes to ERAP2 mRNA. In some embodiments, the inhibitory nucleic acid molecule comprises an siRNA that hybridizes to ERAP2 mRNA. In some embodiments, the inhibitory nucleic acid molecule comprises an shRNA that hybridizes to ERAP2 mRNA. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013. In some embodiments, the ERAP2 inhibitor comprises a small molecule.

HLA-class-I antibodies can be generated by numerous methodologies with different degrees of antigen/allele specificity attained and are reported to be used for in vitro assays. HLA-B27 antibodies can be generated by numerous methodologies. In addition, three commercially available antibodies for HLA-B27 flow cytometric screening include the monoclonal mouse anti-human ABC-m3, FD705, and GS145.2 which have been shown to each have differing levels of cross-reactivity to other HLA-B antigens/alleles (Levering et al., Cytometry B Clin. Cytom., 2003, 54, 28-38).

In some embodiments, the assay for determining whether the subject comprises an MHC-I-opathy-related and/or MHC-II-opathy-related HLA genotype and a functional ERAP2 protein, or a nucleic acid molecule encoding a functional ERAP2 protein, is a genotyping assay or sequencing assay. In some embodiments, the nucleic acid molecule encoding a functional ERAP2 protein comprises genomic DNA, mRNA, or cDNA obtained from mRNA. By comparing the nucleotide or protein sequence of the ERAP2 protein in the sample from a subject to the wild type sequence for ERAP2 protein or nucleic acid molecule, or to published sequences of variant ERAP2 proteins or nucleic acid molecules having reduced or no activity, a determination can be made whether the subject comprises a functional ERAP2 protein, or a nucleic acid molecule encoding a functional ERAP2 protein. In addition, although an individual ERAP2 protein may have biological activity, the overall function of the ERAP2 protein may not be functional due to reduced levels of expression. Thus, as used herein, an ERAP2 protein can be determined not to be functional because the ERAP2 protein lacks or had reduced biological activity or because the expression level is reduced.

Determining whether a subject has an MHC-I-opathy-related and/or MHC-II-opathy-related HLA genotype and/or a functional ERAP2 protein, or a nucleic acid molecule encoding a functional ERAP2 protein, in a biological sample from a subject can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a biological sample obtained from the subject.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any particular nucleic acid molecule, preliminary processing designed to isolate or enrich the biological sample for the particular nucleic acid molecule can be employed. A variety of techniques may be used for this purpose. Various methods to detect the presence or level of an mRNA molecule or the presence of a particular genomic DNA locus can be used.

In some embodiments, the biological sample comprises a cell or cell lysate. Such methods can further comprise, for example, obtaining a biological sample from the subject comprising genomic nucleic acid molecules or mRNA molecules, and if mRNA, optionally reverse transcribing the mRNA into cDNA. In some embodiments, the method is an in vitro method. In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

Administration of any of the therapeutic agents described herein (including the ERAP2 inhibitor, and/or the HLA inhibitor) can be in a therapeutically effective amount to be determined by a health care professional. Administration of any of the therapeutic agents can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of any of the therapeutic agents can occur by any suitable route including, but not limited to, parenteral, intravenous, oral, subcutaneous, intra-arterial, intracranial, intrathecal, intraperitoneal, topical, intranasal, intra-articular, intravitreal, intracameral, subretinal, suprachoroidal, or intramuscular.

Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in an MHC-I-opathy and/or MHC-II-opathy, a decrease/reduction in the severity of an MHC-I-opathy and/or MHC-II-opathy (such as, for example, a reduction or inhibition of development of an MHC-I-opathy and/or MHC-II-opathy), a decrease/reduction in symptoms and MHC-I-opathy-related effects and/or MHC-II-opathy-related effects, delaying the onset of symptoms and MHC-I-opathy-related effects and/or MHC-II-opathy-related effects, reducing the severity of symptoms of MHC-I-opathy-related effects and/or MHC-II-opathy-related effects, reducing the severity of an acute episode, reducing the number of symptoms and MHC-I-opathy-related effects and/or MHC-II-opathy-related effects, reducing the latency of symptoms and MHC-I-opathy-related effects and/or MHC-II-opathy-related effects, an amelioration of symptoms and MHC-I-opathy-related effects and/or MHC-II-opathy-related effects, reducing secondary symptoms, reducing secondary infections, preventing relapse to an MHC-I-opathy and/or MHC-II-opathy, decreasing the number or frequency of relapse episodes, increasing latency between symptomatic episodes, increasing time to sustained progression, speeding recovery, or increasing efficacy of or decreasing resistance to alternative therapeutics, and/or an increased survival time of the subject, following administration of the agent or composition comprising the agent. A prophylactic effect may comprise a complete or partial avoidance/inhibition or a delay of an MHC-I-opathy and/or MHC-II-opathy development/progression (such as, for example, a complete or partial avoidance/inhibition or a delay), and an increased survival time of the affected subject, following administration of a therapeutic protocol. Treatment of an MHC-I-opathy and/or MHC-II-opathy encompasses the treatment of subjects already diagnosed as having any form of the MHC-I-opathy and/or MHC-II-opathy at any clinical stage or manifestation, the delay of the onset or evolution or aggravation or deterioration of the symptoms or signs of an MHC-I-opathy and/or MHC-II-opathy, and/or preventing and/or reducing the severity of an MHC-I-opathy and/or MHC-II-opathy.

In some embodiments, the ERAP2 antisense nucleic acid molecules comprise or consist of any of the nucleotide sequences represented by SEQ ID NOs: 1-858. In some embodiments, the ERAP2 siRNA molecules comprise or consist of any of the nucleotide sequences (sense and antisense strands presented one after the other) represented by SEQ ID NOs: 859-2748 (e.g., the sense strand is, for example, SEQ ID NO: 859 and the corresponding antisense strand is SEQ ID NO: 860; the sense strand is, for example, SEQ ID NO: 861 and the corresponding antisense strand is SEQ ID NO: 862; the sense strand is, for example, SEQ ID NO: 2747 and the corresponding antisense strand is SEQ ID NO: 2748; etc.).

In some embodiments, the HLA-A antisense nucleic acid molecules comprise or consist of any of the nucleotide sequences represented by SEQ ID NOs: 2749-2763. In some embodiments, the HLA-A siRNA molecules comprise or consist of any of the nucleotide sequences (sense and antisense strands presented one after the other) represented by SEQ ID NOs: 2764-2777 (e.g., the sense strand is, for example, SEQ ID NO: 2764 and the corresponding antisense strand is SEQ ID NO: 2765; the sense strand is, for example, SEQ ID NO: 2766 and the corresponding antisense strand is SEQ ID NO: 2767; the sense strand is, for example, SEQ ID NO: 2776 and the corresponding antisense strand is SEQ ID NO: 2777; etc.).

In some embodiments, the HLA-B antisense nucleic acid molecules comprise or consist of any of the nucleotide sequences represented by SEQ ID NO: 2778 and SEQ ID NO: 2779. In some embodiments, the HLA-B siRNA molecules comprise or consist of any of the nucleotide sequences (sense and antisense strands presented one after the other) represented by SEQ ID NOs: 2780-2783 (e.g., the sense strand is, for example, SEQ ID NO: 2780 and the corresponding antisense strand is SEQ ID NO: 2781; the sense strand is, for example, SEQ ID NO: 2783 and the corresponding antisense strand is SEQ ID NO: 2783).

In some embodiments, the HLA-C antisense nucleic acid molecules comprise or consist of any of the nucleotide sequences represented by SEQ ID NO: 2784 and SEQ ID NO: 2785. In some embodiments, the HLA-C siRNA molecules comprise or consist of any of the nucleotide sequences (sense and antisense strands presented one after the other) represented by SEQ ID NO: 2786 and SEQ ID NO: 2787.

In some embodiments, the B27 antisense nucleic acid molecules comprise or consist of any of the nucleotide sequences represented by SEQ ID NOs: 2788-3132. In some embodiments, the B27 siRNA molecules comprise or consist of any of the nucleotide sequences (sense and antisense strands presented one after the other) represented by SEQ ID NOs: 3133-3870 (e.g., the sense strand is, for example, SEQ ID NO: 3133 and the corresponding antisense strand is SEQ ID NO: 3134; the sense strand is, for example, SEQ ID NO: 3135 and the corresponding antisense strand is SEQ ID NO: 3136; the sense strand is, for example, SEQ ID NO: 3869 and the corresponding antisense strand is SEQ ID NO: 3870; etc.).

In some embodiments, the A29 antisense nucleic acid molecules comprise or consist of any of the nucleotide sequences represented by SEQ ID NOs: 3871-4145. In some embodiments, the A29 siRNA molecules comprise or consist of any of the nucleotide sequences (sense and antisense strands presented one after the other) represented by SEQ ID NOs: 4146-4755 (e.g., the sense strand is, for example, SEQ ID NO: 4146 and the corresponding antisense strand is SEQ ID NO: 4147; the sense strand is, for example, SEQ ID NO: 4148 and the corresponding antisense strand is SEQ ID NO: 4149; the sense strand is, for example, SEQ ID NO: 4754 and the corresponding antisense strand is SEQ ID NO: 4755; etc.).

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $-O[(CH_2)_nO]_mCH_3$, $-O(CH_2)_nOCH_3$, $-O(CH_2)_nNH_2$, $-O(CH_2)_nCH_3$, $-O(CH_2)_n-ONH_2$, and $-O(CH_2)_nON[(CH_2)_nCH_3)]_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:

Sense: mN*mN*/i2FN/mN/i2FN/mN/i2FN/mN/i2FN/mN/i2FN/mN/i2FN/mN/i2FN/mN/5 i2FN/*mN*/32FN/
Antisense: /52FN/*/i2FN/*mN/i2FN/mN/i2FN/mN/i2FN/mN/i2FN/mN/i2FN/mN/i2FN/mN/i2FN/mN*N*N wherein: "N" is the base; "2F" is a 2'-F modification; "m" is a 2'-O-methyl modification, "I" is an internal base; and "*" is a phosphorothioate backbone linkage.

The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

The present disclosure also provides methods of identifying a subject having an increased risk for developing an MHC-I-opathy and/or an MHC-II-opathy. The methods comprise performing or having performed an assay on a biological sample from the subject to determine whether the subject comprises: i) an MHC-I-opathy-related HLA genotype and/or an MHC-II-opathy-related HLA genotype; and ii) a functional ERAP2 protein or a nucleic acid molecule encoding a functional ERAP2 protein. When the subject has both the MHC-I-opathy-related HLA genotype and/or an MHC-II-opathy-related HLA genotype and the functional ERAP2 protein or the nucleic acid molecule encoding the functional ERAP2 protein, then the subject has an increased risk of developing the MHC-I-opathy and/or an MHC-II-opathy. When the subject lacks the MHC-I-opathy-related HLA genotype and/or an MHC-II-opathy-related HLA genotype, or lacks the functional ERAP2 protein or the nucleic acid molecule encoding the functional ERAP2 protein, or lacks both, then the subject has a decreased risk of developing the MHC-I-opathy and/or an MHC-II-opathy. In some embodiments, the method further comprises determining whether the subject has a single copy of the MHC-I-opathy-related HLA genotype and/or an MHC-II-opathy-related HLA genotype or two copies of the MHC-I-opathy-related HLA genotype and/or an MHC-II-opathy-related HLA genotype. When the subject comprises two copies of the MHC-I-opathy-related HLA genotype and/or an MHC-II-opathy-related HLA genotype, then the subject has an increased risk of developing the MHC-I-opathy and/or an MHC-II-opathy compared to comprising a single copy of the MHC-I-opathy-related HLA genotype and/or an MHC-II-opathy-related HLA genotype.

In some embodiments, the MHC-I-opathy is BSCR. In some embodiments, the subject is HLA-Aw19$^+$. In some embodiments, the subject is or is suspected of being HLA-A29$^+$, HLA-A30$^+$, HLA-A31$^+$, or HLA-A33$^+$, or any combination thereof. In some embodiments, the subject has a single copy of HLA-Aw19. In some embodiments, the subject has two copies of HLA-Aw19. In some embodiments, the subject is HLA-A29$^+$/HLA-A30$^+$. In some embodiments, the subject is HLA-A29$^+$/HLA-A31$^+$. In some embodiments, the subject is HLA-A29$^+$/HLA-A33$^+$.

In some embodiments, the subject having BSCR is not HLA-A29$^+$.

In some embodiments, the subject having BSCR has a copy of at least any two of HLA-A29, HLA-A30, HLA-A31, or HLA-A33. In some embodiments, the subject having BSCR has a copy of at least any three of HLA-A29, HLA-A30, HLA-A31, or HLA-A33. In some embodiments, the subject having BSCR has a copy of all of HLA-A29, HLA-A30, HLA-A31, or HLA-A33.

In some embodiments, the subject having BSCR has one copy of each HLA-A29 and HLA-A30. In some embodiments, the subject having BSCR has one copy of each HLA-A29 and HLA-A31. In some embodiments, the subject having BSCR has one copy of each HLA-A29 and HLA-A33. In some embodiments, the subject having BSCR has one copy of each HLA-A30 and HLA-A31. In some embodiments, the subject having BSCR has one copy of each HLA-A30 and HLA-A33. In some embodiments, the subject having BSCR has one copy of each HLA-A31 and HLA-A33.

In some embodiments, the subject having BSCR has one copy of HLA-A29 and two copies of HLA-A30. In some embodiments, the subject having BSCR has one copy of HLA-A29 and two copies of HLA-A31. In some embodiments, the subject having BSCR has one copy of HLA-A29 and two copies of HLA-A33. In some embodiments, the subject having BSCR has one copy of HLA-A30 and two copies of HLA-A31. In some embodiments, the subject having BSCR has one copy of HLA-A30 and two copies HLA-A33. In some embodiments, the subject having BSCR has one copy of HLA-A31 and two copies of HLA-A33.

In some embodiments, the subject having BSCR has two copies of HLA-A29 and one copy of HLA-A30. In some embodiments, the subject having BSCR has two copies of HLA-A29 and one copy of HLA-A31. In some embodiments, the subject having BSCR has two copies of HLA-A29 and one copy of HLA-A33. In some embodiments, the subject having BSCR has two copies of HLA-A30 and one copy of HLA-A31. In some embodiments, the subject having BSCR has two copies of HLA-A30 and one copy of HLA-A33. In some embodiments, the subject having BSCR has two copies of HLA-A31 and one copy of HLA-A33.

In some embodiments, the subject having BSCR or suspected of having BSCR has two copies of HLA-A29 and two copies of HLA-A30. In some embodiments, the subject having BSCR or suspected of having BSCR has two copies of HLA-A29 and two copies of HLA-A31. In some embodiments, the subject having BSCR or suspected of having BSCR has two copies of HLA-A29 and two copies of HLA-A33. In some embodiments, the subject having BSCR or suspected of having BSCR has two copies of HLA-A30 and two copies of HLA-A31. In some embodiments, the subject having BSCR or suspected of having BSCR has two copies of HLA-A30 and two copies of HLA-A33. In some embodiments, the subject having BSCR or suspected of having BSCR has two copies of HLA-A31 and two copies of HLA-A33.

In some embodiments, the method further comprises administering to the subject an HLA-Aw19 inhibitor. In some embodiments, the HLA-Aw19 inhibitor comprises an antibody. In some embodiments, the antibody comprises an anti-HLA-A29 antibody. In some embodiments, the HLA-Aw19 inhibitor comprises a small molecule degrader or an inhibitory nucleic acid molecule. In some embodiments, the inhibitory nucleic acid molecule comprises an antisense nucleic acid molecule, a small interfering RNA (siRNA), or a short hairpin RNA (shRNA) that hybridizes to an HLA-Aw19. In some embodiments, the HLA-Aw19 is HLA-A29.

In some embodiments, the MHC-I-opathy is AS. In some embodiments, the subject is or is suspected of being HLA-B27$^+$ or HLA-B40$^+$. In some embodiments, the subject has a single copy of HLA-B27 or HLA-B40. In some embodiments, the subject has two copies of HLA-B27 or HLA-B40. In some embodiments, the method further comprises administering to the subject an HLA-B27 inhibitor or an HLA-B40 inhibitor. In some embodiments, the HLA-B27 inhibitor or HLA-B40 inhibitor comprises an antibody. In some embodiments, the antibody comprises an anti-HLA-B27 antibody or an anti-HLA-B40 antibody. In some embodiments, the HLA-B27 inhibitor or HLA-B40 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27 or HLA-B40.

In some embodiments, the MHC-I-opathy is psoriasis in combination with uveitis. In some embodiments, the uveitis is anterior uveitis. In some embodiments, the subject is or is suspected of being HLA-B27$^+$. In some embodiments, the subject has a single copy of HLA-B27. In some embodiments, the subject has two copies of HLA-B27. In some embodiments, the method further comprises administering to the subject an HLA-B27 inhibitor. In some embodiments, the HLA-B27 inhibitor comprises an antibody. In some embodiments, the antibody comprises an anti-HLA-B27 antibody. In some embodiments, the HLA-B27 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27.

In some embodiments, the MHC-I-opathy is JIA. In some embodiments, the subject is or is suspected of being HLA-B27$^+$ and/or DRB1$^+$. In some embodiments, the subject has a single copy of HLA-B27 and/or DRB1. In some embodiments, the subject has two copies of HLA-B27 and/or DRB1. In some embodiments, the method further comprises administering to the subject an HLA-B27 inhibitor and/or a DRB1 inhibitor. In some embodiments, the HLA-B27 inhibitor and/or DRB1 inhibitor comprises an antibody. In some embodiments, the antibody comprises an anti-HLA-B27 antibody or an anti-DRB1 antibody. In some embodiments, the HLA-B27 inhibitor and/or DRB1 inhibitor comprises a small molecule degrader or an inhibitory nucleic acid molecule. In some embodiments, the inhibitory nucleic acid molecule comprises an antisense nucleic acid molecule, an siRNA, or an shRNA that hybridizes to an HLA-B27 and/or an DRB1.

In any of the embodiments described herein, the methods can further comprise administering to the subject having an increased risk of developing the MHC-I-opathy-related HLA genotype and/or an MHC-II-opathy an ERAP2 inhibitor. In some embodiments, the ERAP2 inhibitor comprises a small molecule degrader, a proteoloysis-targeting chimera, an immunomodulatory drug, or an inhibitory nucleic acid molecule. In some embodiments, the inhibitory nucleic acid molecule comprises an antisense nucleic acid molecule, an siRNA, or an shRNA that hybridizes to ERAP2 mRNA. In some embodiments, the inhibitory nucleic acid molecule comprises an antisense nucleic acid molecule that hybridizes to ERAP2 mRNA. In some embodiments, the inhibitory nucleic acid molecule comprises an siRNA that hybridizes to ERAP2 mRNA. In some embodiments, the inhibitory nucleic acid molecule comprises an shRNA that hybridizes to ERAP2 mRNA. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013. In some embodiments, the phosphinic pseudopeptide is DG002. In some embodiments, the phosphinic pseudopeptide is DG013. In some embodiments, the ERAP2 inhibitor comprises a small molecule.

In some embodiments, the assay for determining whether the subject comprises an MHC-I-opathy-related and/or MHC-II-opathy-related HLA genotype and a functional ERAP2 protein, or a nucleic acid molecule encoding a functional ERAP2 protein, is a genotyping assay or sequencing assay. In some embodiments, the nucleic acid molecule encoding a functional ERAP2 protein comprises genomic DNA, mRNA, or cDNA obtained from mRNA. By comparing the nucleotide or protein sequence of the ERAP2 protein in the sample from a subject to the wild type sequence for ERAP2 protein or nucleic acid molecule, or to published sequences of variant ERAP2 proteins or nucleic acid molecules having reduced or no activity, a determination can be made whether the subject comprises a functional ERAP2 protein, or a nucleic acid molecule encoding a functional ERAP2 protein. In addition, although an individual ERAP2 protein may have biological activity, the overall function of the ERAP2 protein may not be functional due to reduced levels of expression. Thus, as used herein, an ERAP2 protein can be determined not to be functional because the ERAP2 protein lacks or had reduced biological activity or because the expression level is reduced.

Determining whether a subject has an MHC-I-opathy-related and/or MHC-II-opathy-related HLA genotype and/or a functional ERAP2 protein, or a nucleic acid molecule encoding a functional ERAP2 protein, in a biological sample from a subject can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a biological sample obtained from the subject.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any particular nucleic acid molecule, preliminary processing designed to isolate or enrich the biological sample for the particular nucleic acid molecule can be employed. A variety of techniques may be used for this purpose. Various methods to detect the presence or level of an mRNA molecule or the presence of a particular genomic DNA locus can be used.

In some embodiments, the biological sample comprises a cell or cell lysate. Such methods can further comprise, for example, obtaining a biological sample from the subject comprising genomic nucleic acid molecules or mRNA molecules, and if mRNA, optionally reverse transcribing the mRNA into cDNA. In some embodiments, the method is an in vitro method. In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

Detecting the presence or absence of any particular HLA allele can be carried out by numerous techniques. Detection of HLA-A alleles on a 2-digit and 4-digit resolution can be carried out. For example, an assay that targets the HLA region in high resolution (all class-I and class-II genes) can be used. In some embodiments, the assay amplifies the full HLA gene (in this case HLA-A) from the 5'UTR to the 3'UTR and provides genetic variants across the full amplicon (the DNA that is the product of this amplification of the gene). A method can then be used to call the HLA-A alleles with high accuracy (e.g., PHLAT2; Bai et al., Methods Mol. Biol., 2018, 1802, 193-201). The output of PHLAT2 provides the HLA-A 4-digits allele data for each sample, which can be used for the analysis that identified other Aw19 alleles as enriched in Birdshot cases. In addition, commercial sources of HLA typing are available.

Detecting the presence or absence a functional ERAP2 protein, or a nucleic acid molecule encoding a functional ERAP2 protein, can be carried out by numerous techniques. For example, detection of presence or absence of ERAP2 protein and the relevant nucleotide sequence can be carried out as described in Andres et al., PLoS Genetics, 2010, 6, 1-13. For example, a subject having an ERAP2 intronic variant designated rs2248374-A has a functional ERAP2 protein, or a nucleic acid molecule encoding a functional ERAP2 protein, and has an increased risk of developing the MHC-I-opathy. A subject having an ERAP2 variant designated rs10044354, HapA has a functional ERAP2 protein, or a nucleic acid molecule encoding a functional ERAP2 protein, and has an increased risk of developing the MHC-I-opathy. A subject having an ERAP2 splice variant designated rs2248374-G does not have a functional ERAP2 protein, or a nucleic acid molecule encoding a functional ERAP2 protein, and has a decreased risk of developing the MHC-I-opathy.

Representative embodiments of the present disclosure include but are not limited to the following.

The present disclosure provides methods of treating a subject having an immune disorder, the methods comprising administering to the subject an ERAP2 inhibitor and: i) an HLA-A29 inhibitor and/or ii) an HLA-B27 inhibitor. In some embodiments, the immune disorder is an MHC-I-opathy.

The present disclosure also provides methods of treating a subject having an MHC-1-opathy, the methods comprising: performing or having performed an assay on a biological sample from the subject to determine whether the subject comprises: i) an HLA-A29 allele and/or an HLA-B27 allele; and ii) a functional ERAP2 protein or a nucleic acid molecule encoding a functional ERAP2 protein; and administering to the subject a therapeutically effective amount of an ERAP2 inhibitor and an HLA-A29 inhibitor to the subject having the functional ERAP2 protein or the nucleic acid molecule encoding a functional ERAP2 protein, and having the HLA-A29 allele; or administering to the subject a therapeutically effective amount of an ERAP2 inhibitor and an HLA-B27 inhibitor to the subject having the functional ERAP2 protein or the nucleic acid molecule encoding a functional ERAP2 protein, and having the HLA-B27 allele; wherein the presence of both: i) the HLA-A29 allele and/or the HLA-B27 allele, and ii) the functional ERAP2 protein or the nucleic acid molecule encoding a functional ERAP2 protein, indicates that the subject is a candidate for treating the MHC-I-opathy by inhibiting ERAP2.

The present disclosure also provides a combination of an ERAP2 inhibitor and an HLA-A29 inhibitor for use in the treatment of an immune disorder. The present disclosure also provides a combination of an ERAP2 inhibitor and an HLA-A29 inhibitor for use in the preparation of a medicament for treating an immune disorder. In some embodiments, the immune disorder is an MHC-I-opathy.

In some embodiments, the MHC-I-opathy is BSCR, and the method comprises administering the ERAP2 inhibitor and the HLA-A29 inhibitor to the subject. In some embodiments, the methods further comprise detecting the presence or absence of an HLA-A29 allele in a biological sample obtained from the subject. In some embodiments, the methods further comprise determining whether the subject has one or two copies of an HLA-A29 allele. In some embodiments, the HLA-29 inhibitor comprises an antibody. In some embodiments, the HLA-A29 inhibitor comprises a small molecule degrader or an inhibitory nucleic acid molecule. In some embodiments, the inhibitory nucleic acid molecule comprises an antisense nucleic acid molecule, an siRNA, or a short hairpin RNA that hybridizes to an HLA-A29. In some embodiments, the antisense nucleic acid molecule comprises a nucleotide sequence selected from the group consisting of SEQ ID NOs: 3871-4145. In some embodiments, the siRNA molecule comprises a sense strand and a corresponding antisense strand selected from the group consisting of SEQ ID NOs: 4146-4755.

In some embodiments, the MHC-I-opathy is AS, and the methods comprise administering the ERAP2 inhibitor and the HLA-B27 inhibitor to the subject. In some embodiments, the methods further comprise detecting the presence or absence of an HLA-B27 allele in a biological sample obtained from the subject. In some embodiments, the methods further comprise determining whether the subject has one or two copies of an HLA-B27 allele. In some embodiments, the HLA-B27 inhibitor comprises an antibody. In some embodiments, the HLA-B27 inhibitor comprises a small molecule degrader or an inhibitory nucleic acid molecule. In some embodiments, the inhibitory nucleic acid molecule comprises an antisense nucleic acid molecule, an siRNA, or a short hairpin RNA that hybridizes to an HLA-B27. In some embodiments, the antisense nucleic acid molecule comprises a nucleotide sequence selected from the group consisting of SEQ ID NOs: 2788-3132. In some embodiments, the siRNA molecule comprises a sense strand and a corresponding antisense strand selected from the group consisting of SEQ ID NOs: 3133-3870.

In some embodiments, the MHC-I-opathy is psoriasis and the subject also has uveitis, and the methods comprise administering the ERAP2 inhibitor and the HLA-B27 inhibitor to the subject. In some embodiments, the uveitis is anterior uveitis. In some embodiments, the methods further comprise detecting the presence or absence of an HLA-B27 allele in a biological sample obtained from the subject. In some embodiments, the methods further comprise determining whether the subject has one or two copies of an HLA-B27 allele. In some embodiments, the HLA-B27 inhibitor comprises an antibody. In some embodiments, the HLA-B27 inhibitor comprises a small molecule degrader or an inhibitory nucleic acid molecule. In some embodiments, the inhibitory nucleic acid molecule comprises an antisense nucleic acid molecule, an siRNA, or a short hairpin RNA that hybridizes to an HLA-B27. In some embodiments, the antisense nucleic acid molecule comprises a nucleotide sequence selected from the group consisting of SEQ ID NOs: 2788-3132. In some embodiments, the siRNA molecule comprises a sense strand and a corresponding antisense strand selected from the group consisting of SEQ ID NOs: 3133-3870.

In some embodiments, the MHC-I-opathy is JIA, and the methods comprise administering the ERAP2 inhibitor and the HLA-B27 inhibitor to the subject. In some embodiments, the methods further comprise detecting the presence or absence of an HLA-B27 allele in a biological sample obtained from the subject. In some embodiments, the methods further comprise determining whether the subject has one or two copies of an HLA-B27 allele. In some embodiments, the HLA-B27 inhibitor comprises an antibody. In some embodiments, the HLA-B27 inhibitor comprises a small molecule degrader or an inhibitory nucleic acid molecule. In some embodiments, the inhibitory nucleic acid molecule comprises an antisense nucleic acid molecule, an siRNA, or a short hairpin RNA that hybridizes to an HLA-B27. In some embodiments, the antisense nucleic acid molecule comprises a nucleotide sequence selected from the group consisting of SEQ ID NOs: 2788-3132. In some embodiments, the siRNA molecule comprises a sense strand and a corresponding antisense strand selected from the group consisting of SEQ ID NOs: 3133-3870.

In some embodiments, the ERAP2 inhibitor comprises a small molecule degrader or an inhibitory nucleic acid molecule. In some embodiments, the inhibitory nucleic acid molecule comprises an antisense nucleic acid molecule, an siRNA, or a short hairpin RNA that hybridizes to ERAP2 mRNA. In some embodiments, the antisense nucleic acid molecule comprises a nucleotide sequence selected from the group consisting of SEQ ID NOs: 1-858. In some embodiments, the siRNA molecule comprises a sense strand and a corresponding antisense strand selected from the group consisting of SEQ ID NOs: 859-2748. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013. In some embodiments, the ERAP2 inhibitor comprises a small molecule.

The present disclosure also provides pharmaceutical compositions comprising one or more ERAP2 inhibitors in combination with one or more HLA-A29 inhibitors. The present disclosure also provides pharmaceutical compositions comprising one or more ERAP2 inhibitors in combination with one or more HLA-B27 inhibitors. The present disclosure also provides pharmaceutical compositions comprising one or more ERAP2 inhibitors in combination with one or more HLA-A29 inhibitors and one or more HLA-B27 inhibitors.

In order that the subject matter disclosed herein may be more efficiently understood, examples are provided below. It

EXAMPLES

Example 1: Methods

Study Subjects and Samples

The genomic DNA samples from 286 patients with BSCR and 108 unrelated healthy local French volunteers that exhibited HLA tissue typing common in the French population were included in this study. The patients were recruited at Hôpital Cochin, Paris, France. All patients met the criteria for diagnosis of BSCR as defined both by an international consensus conference held in 2002 and by the Standardization of Uveitis Nomenclature (SUN) Working Group. In brief, all patients had a posterior bilateral uveitis with multifocal cream-colored or yellow-orange, oval or round choroidal lesions ("birdshot spots"). Although the presence of the HLA-A29 allele was not a requirement for the diagnosis of BSCR according to the international criteria, all patients included in the current study carried the HLA-A29 allele. The control DNA samples were collected from volunteer donors recruited by the hematopoietic stem cell donor center of Rheims for France Greffe de Moelle Registry, and local control healthy individuals of the Registry. The DNA samples were isolated from peripheral blood samples using a standard salting out method or QIAamp Blood Kit (Qiagen, Chatsworth, CA, USA). Quality and quantity of DNA was determined by UV spectrophotometry and the concentration was adjusted to 100 ng/ml. Signed informed consent documentation was obtained from all participants, and all research adhered to the tenets set forth in the Declaration of Helsinki. All study-related data acquisitions were approved by the Paris Cochin institutional review board.

Genetic Data

A comprehensive approach was taken to both sequence the exomes and genotype all samples, to allow for identification of common and rare variants filtered based on high quality calls. DNA from participants was genotyped on the Illumina Global Screening Array (GSA) and imputed to the HRC reference panel. Prior to imputation, the variants that had a MAF>=0.1%, missingness <1% and HWE p-value >$10^{-15}$ were retained. Imputation using the HRC reference panel yielded 8,385,561 variants with imputation INFO>0.3 and MAF>0.5%.

Exome sequencing was performed to a mean depth of 31x, followed by variant calling and quality control as reported previously (Van Hout et al., Nature, 2020, 586, 749-756), resulting in 238,942 variants. When integrated, this produced an overall dataset with 8,459,907 variants: 65.5% common (MAF>5%), 34.5% low-frequency (0.5%<MAF<5%) and 0.01% rare (MAF<0.5%).

HLA Genotyping

HLA Class I genes (HLA-A, -B, and -C) were amplified in a multiplex PCR reaction with primers encompassing the full genomic loci for each target. The resulting amplicons were enzymatically fragmented to an average size of 250 base pairs and prepared for Illumina sequencing (New England Biolabs, Ipswich, MA). The libraries were sequenced on the Illumina HiSeq 2500 platform on a rapid run flow cell using paired-end 125 base pair reads with dual 10 base pair indexes. Upon completion of sequencing, raw data from each Illumina HiSeq run was gathered in local buffer storage and uploaded to the DNAnexus platform (Reid et al., BMC Bioinformatics, 2014, 15, 30) for automated analysis. The FASTQ-formatted reads were converted from the BCL files and assigned to samples identified by specific barcodes using the bcl2fastq conversion software (Illumina Inc., San Diego, CA). All the reads in sample-specific FASTQ files were subject to HLA typing analysis using an updated version of PHLAT program (Bai et al., BMC Genomics, 2014, 15, 325) with the reference sequences consisting of GRCh38 genomic sequences and HLA type reference sequences in the IPD-IMGT/HLA database v3.30.0 (Robinson et al., Hum. Immunol., 2016, 77, 233-237).

In addition, HLA allele imputation was performed following SNP2HLA (Jia et al., PLoS One, 2013, 8, e64683) with the T1DGC HLA allele reference panel (Rich et al., Ann. N.Y. Acad. Sci., 2006, 1079, 1-8). HRC-imputed genotypes in the extended Major Histocompatibility Complex (MHC) region (chr6:25-35 Mb) were filtered for high INFO score (>0.9) and certainty (maximum GP>0.8 for all genotyped), in order to increase overlap with the T1DGC reference panel, were re-phased along with chromosome 6 array genotypes using SHAPEIT4 (Delaneau et al., Nat. Commun., 2019, 10, 5436), and were imputed using Minimac4 (Das et al., Nat. Genet., 2016, 48, 1284-1287). HLA allele imputation quality was assessed by examining INFO score vs MAF, and imputed vs reference panel MAF.

Genetic Association Analyses

Association analyses in each study were performed using the genome-wide Firth logistic regression test implemented in SAIGE (Mbatchou et al., bioRxiv, 2020, 2020.2006.2019.162354, doi:10.1101/2020.06.19.162354; and Zhou et al., Nat. Genet., 2018, 50, 1335-1341). In this implementation, Firth's approach is applied when the p-value from standard logistic regression score test is below 0.05. The directly genotyped variants with a minor allele frequency (MAF)>1%, <10% missingness, Hardy-Weinberg equilibrium test P-value>$10^{-15}$ and linkage-disequilibrium (LD) pruning (1000 variant windows, 100 variant sliding windows and $r^2$<0.1) were included for GRM for SAIGE. The association model included as covariates sex and the first 10 ancestry-informative principal components (PCs) derived from the GRM dataset. Haplotype analyses were performed using PLINK 1.0 (Purcell et al., Am. J. Hum. Genet., 2007, 81, 559-575) --chap and --hap-assoc and --hap-logistic, and in R. High haplotype imputation and phasing quality was indicated by PLINK --hap-phase maximum likelihood haplotype genotypes' posterior probabilities all equal to one.

HLA-A Allele Association Analyses

Association of HLA-A alleles was performed as follows: for each sample, both HLA-A alleles were typed as described above. Following HLA allele typing, related samples were removed. For the remaining cohort of 282 cases and 106 controls, one HLA-A allele that is not A29 (the "second" allele) was obtained next. Samples carrying two copies of A29, were considered having A29 as the second allele. The cohort was then subjected to a Fisher's exact test, which tested the association of each allele that was identified in three or more BSCR cases, with the case-control status. To answer the question of whether the A19 allele group is also associated with the case-control status, the samples were combined, and tested together in two different ways: carrying all Aw19 alleles (A29, A30, A31, A32 and A33). Since A32 is biologically different than the other Aw19 alleles in its peptide binding domain, a group that is made of samples carrying all Aw19 alleles excluding A32 was also constructed and tested. The final odds-ratios and p-values are presented in the table in FIG. 1.

Example 2: HLA-Aw19 Broad Antigen Serotype Alleles and BSCR Risk

The HLA-A29-controlled cohort allowed for examination of the HLA region while controlling for the strong association of HLA-A29 with BSCR, and therefore to detect possible additional association signals in the HLA region.

First, it was asked whether rare variants on the HLA-A29 background were enriched in BSCR cases. No significant enrichments of rare single or aggregated variants were identified either within or outside the MHC region.

Second, the question was whether other HLA-A alleles in addition to the HLA-A29 allele increased BSCR risk. An assay to type HLA-A alleles in this cohort (see Methods) was constructed, and tested the second HLA-A allele (other than the known first HLA-A29) was tested for association with BSCR. Additional HLA-A alleles were found to be associated with BSCR, and those with the largest effects belonged to the same HLA-Aw19 broad antigen serotype group: HLA-A29:02, A30:02, A31:01 and A33:01 (FIG. 1). As a group, HLA-Aw19 alleles were significantly enriched in the second allele of BSCR patients (OR=4.44, p=2.2e-03, FIG. 2, blue bars). This result suggests, for example, that individuals carrying two copies of HLA-A29 would be at a greater risk of developing BSCR compared to those carrying one copy. It also suggests that other Aw19 allele may play a role in BSCR co-susceptibility or pathogenesis in concert with A29. The sole exception within the HLA-Aw19 serotype group is HLA-A32, which has been reported not to share the defining Aw19 binding domain (McKenzie et al., Genes Immun., 1999, 1, 120-129); HLA-A32 appears to be depleted in BSCR cases and thus protective against BSCR (OR=0.28, p=0.1).

The above results presented two issues due to the small numbers of controls in UParis (n=108): 1) The frequency of alleles might not represent the frequency of HLA-A alleles in general EUR population. 2) While the high ORs replicate in several HLA-Aw19 alleles, the numbers are not sufficient to support significant associations. To tackle these concerns, the frequency of HLA-A alleles in three other large European (EUR) ancestry control populations, two cohorts from the Geisinger Health System (GHS cohort #1, n=77,198 and GHS cohort #2, n=59,072) and the UK Biobank (UKB, n=463,315) were examined. In all three datasets, the EUR samples carrying at least one HLA-A29 allele were selected, matching the BSCR cohort: 4,014 A29 carriers from GHS cohort #1 (5.2% of all EUR subjects), 2,829 A29 carriers from GHS cohort #2 (4.8% of all EUR), and 38,543 A29 carriers from UKB (8.3% of all EUR). The frequencies of the second HLA-A alleles in these cohorts were compared to those observed in the BSCR cohort (FIG. 2, FIG. 1). The results support the enrichment of four of the five HLA-Aw19 alleles in BSCR cases, with highest increased risk for HLA-A30:02 (GHS cohort #1 OR=4.31, GHS cohort #2 OR=6.6, UKB OR=4.6) and HLA-A33 (GHS cohort #1 OR=3.4, GHS cohort #2 OR=2.8, UKB OR=4.9). When combining samples carrying the four co-susceptibility alleles A29, A30, A31 and A33, was found a highly significant enrichment in BSCR cases was found a when compared with the larger control cohorts (GHS cohort #1 p-val=1.29E-06, GHS cohort #2 p-val=1.07E-06, UKB p-val=9.62E-07, FIG. 1 top row). This analysis excludes A32 because of its biological difference in the sequence of the peptide binding domain as previously reported. The additional analyses with all Aw19 alleles including A32 showed that the enrichment in cases is reduced when it is included (FIG. 1 bottom row).

In order to test whether these associations are affected by measurable confounders, logistic regression tests were conducted to evaluate the effects of the second HLA-A allele in HLA-A29 carriers, in UParis BSCR cases compared with each control cohort, with covariates included for sex and principal components, calculated based on genetic array data for each analytic set (FIG. 3). The results were consistent with increased risk for the HLA-Aw19 co-susceptibility alleles, A29, A30, A31, and A33.

Example 3: HLA-A32 Exhibits Protection from BSCR in an HLA-A29 Positive Cohort

HLA-A32 is underrepresented in BSCR cases (3/286, ~1%) versus A29 carrier controls (4/108, 3.7%), corresponding to a nominally significant protection from risk (OR=0.28, p=0.1; FIG. 1). When compared with the larger control cohorts, the trend protection is maintained with both UKB controls (3.4%, OR=0.3, p=0.02) and GHS controls (cohort #1: 3.8%, OR=0.27, p=0.01; cohort #2: 3.7%, OR=0.27, p=0.02). While nominally significant, this result does not pass the threshold of multiple test correction (p=3.57e-03) and will need to be further validated with additional case cohorts.

Example 4: ERAP2 is Independently Associated with BSCR

All variants and gene burdens were tested for association with case-control status, while controlling for sex and ten principal components, using a generalized linear mixed model (SAIGE). Due to the fact that both cases and controls were A29 allele carriers, the expected strong HLA-A signal was at least partially controlled, as evidenced by the strongest HLA p-value=8.98E-07, compared with p=6.6e-74 with 125 cases in the previous BSCR report (Kuiper et al., Hum. Mol. Genet., 2014, 23, 6081-6087). Overall, no locus passed the genome wide significance threshold (p<5e-8). Other than the remnant signal at HLA-A, only the ERAP1/ERAP2-LNPEP locus on chromosome 5 showed an association with disease at p<1e-6 (FIG. 2).

The previously reported top association for BSCR at this locus tags a common variant near ERAP2/LNPEP, rs10044354. This reported risk allele is in a strong linkage disequilibrium (D'=0.99, $R^2$=0.76), with a strong eQTL increasing ERAP2 expression. The results show a nominal association of rs10044354 with increased risk for Birdshot (OR (95% CI)=1.55 (1.13-2.11), p=5.8e-3). Furthermore, no significant evidence was found for an interaction of rs10044354 with rs27432-rs2287987 haplotypes (conditional haplotype test p=0.46).

Next, a meta-analysis of the results with the published results from Kuiper et al. was carried out, which yielded genome-wide significant associations for ERAP2 (rs10044354, OR (95% CI)=1.95 (1.55-2.44), p=6.2e-09) loci with BSCR (FIG. 1). Both previous and current studies showed consistent directionality for ERAP2, which, separated by over 201,222 bp, show low linkage disequilibrium (LD) in the present cohort (R2=0.18, D'=0.79).

The expression of ERAP2 has been previously reported to be disrupted by a common splice region variant (rs2248374, AF=0.53) that causes mis-splicing of intron 10 and eventual transcript degradation via nonsense-mediated decay (Andres et al., PLoS Genet., 2010, 6, e1001157; and Coulombe-Huntington et al., PLoS Genet., 2009, 5, e1000766), and which is in high LD with rs10044354 (R2=0.8, D'=1). Thus, about 25% of the population of most ancestries (including European, AF=0.53; African, AF=0.57 and South Asian, AF=0.58) is estimated to be lacking an active ERAP2 protein. Both datasets were examined for rs2248374 associations and found that it is protective for BSCR with nominal significance in both datasets (FIG. 4). Furthermore, ERAP2-rs2248374 that disrupts ERAP2 expression is protective (OR 0.56; 95% CI [0.45-0.70]; p=2.39e-07; FIG. 5). In summary, higher expression of ERAP2 protein increases risk for BSCR and a lower expression is protective.

Figure 6:
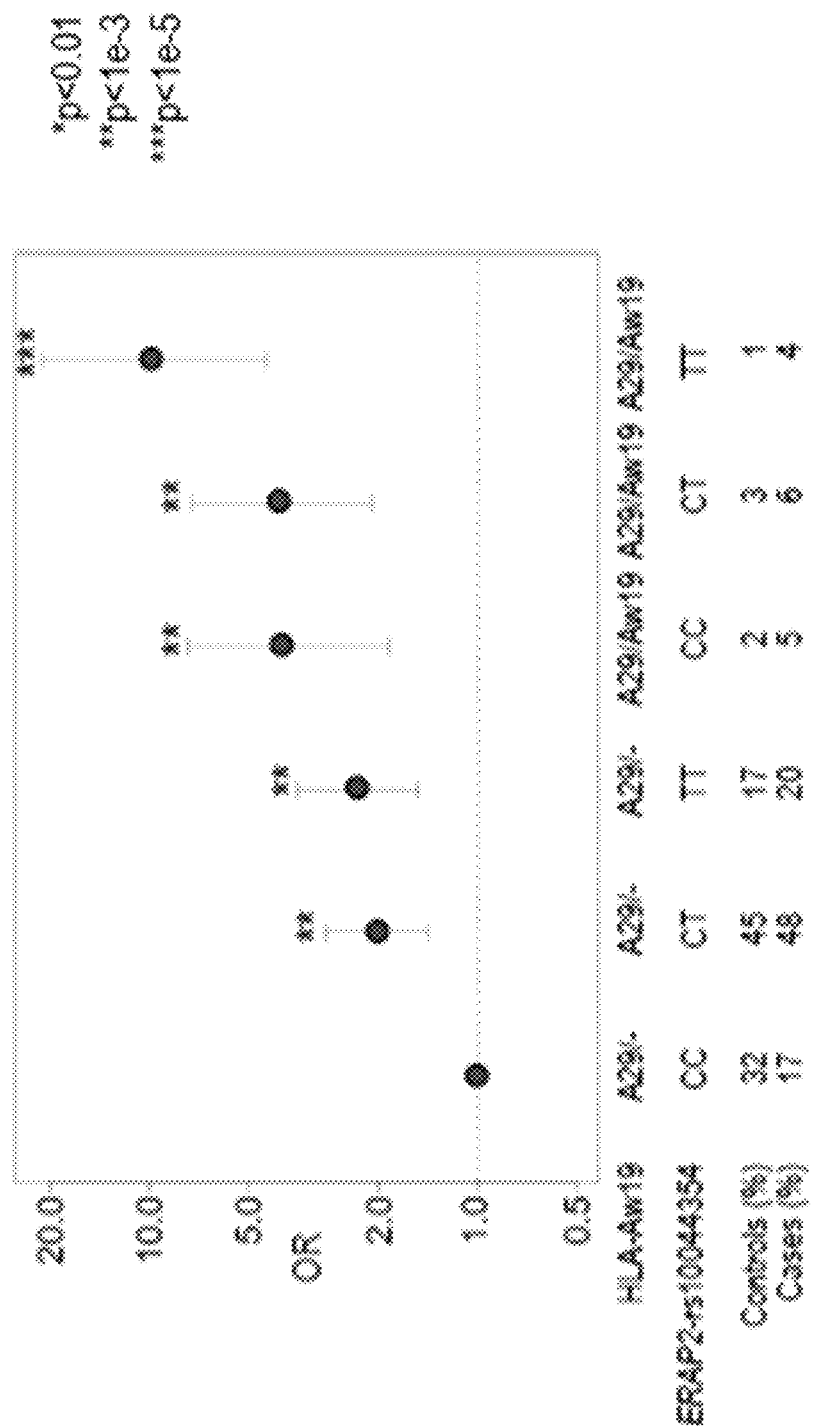
FIG. 6 shows the combined risk of ERAP2 and two copies of Aw19. Utilizing 286 Birdshot cases and 4,014 controls from GHS cohort #1 to calculate additive risk while combining risk factors in ERAP2 and Aw19. An additive genotype model of ERAP2 risk signal tagged by rs10044354 and single (A29/-) or double (A29/Aw19) Aw19 copies relative to lowest risk combination of rs10044354-CC and one copy of Aw19 allele (A29).

Example 5: Cumulative Effect of HLA-Aw19 Alleles and ERAP2 Haplotypes on BSCR Risk The potential interactions between the ERAP2 association signals and between HLA-Aw19 and ERAP2 signals was examined by calculating the cumulative effects of HLA-Aw19, and ERAP2 genotypes on BSCR risk using the 286 cases and the 4,014 A29 carriers from the GHS cohort #1. First, an analysis of ERAP2-rs10044354 risk haplotype, the top non-MHC signal in Kuiper et al. was performed, stratified by single (A29/-) versus double (A29/AW19) Aw19 background, which yielded a trend of increased risk with additional ERAP2-rs10044354-T variant alleles, particularly on the double A29/AW19 background (FIG. 6). The combination of rs10044354-TT and two copies of Aw19 with 12 cases and 34 controls was found to have the highest risk (OR=9.9 [4.4-21.2], p=1.66e-07, FIG. 7).

Example 6: Discussion

The sequencing of a new large BSCR patient cohort and HLA-A29 controls has confirmed the importance of the ERAP2 polymorphisms in increasing risk for developing BSCR. The association of the ERAP2 haplotype is consistent with a mechanism in which increased ERAP2 expression contribute to disease risk. Several studies have reported that ERAP2 haplotypes affect their expression as well as the resulting peptidome (Kuiper et al., Hum. Mol. Genet., 2018, 27, 4333-4343; Paladini et al., Sci. Rep., 2018, 8, 10398; and Sanz-Bravo et al., Mol. Cell Proteomics, 2018, 17, 1564-1577).

The present study found that several other HLA-Aw19 family alleles (HLA-A29, A30, A31, A33) contribute additional risk as the second HLA-A allele, in addition to HLA-A29 risk allele. HLA-Aw19 family alleles have a similar antigen-binding sequence and therefore would bind similar peptide motifs. Hence, the enrichment of Aw19 alleles in cases supports the inferred mechanism underlying activation of the immune response in BSCR: having two copies of these alleles may increase the cell-surface presentation of specific types of peptides in BSCR cases compared to HLA-A29 positive controls. Furthermore, it was found that the HLA-A32 allele within the Aw19 family is potentially protective.

HLA-A32 is the only HLA-Aw19 member that is found at lower rates in BSCR patients compared to controls, suggesting that it could be protective. The HLA-Aw19 serotype was initially identified by antibody binding to related family members; however, this identifies the HLA-A proteins based on structure outside of the peptide-binding groove. Serofamilies have since been re-analyzed by overall and peptide binding region sequences (McKenzie et al., Genes Immun. 1999, 1, 120-129). Comparison of the sequences in the peptide binding region reveals that HLA-A32 is more distantly related than the other Aw19 alleles which are identified as novel risk factors in this present study: HLA-A29, A30, A31, A33. When examining the differences in sequence between these Aw19 alleles, two main differences are evident: at position 9, which is part of the peptide binding domain, and a stretch of amino-acids at positions 79-83 that is only found in HLA-A32 and not the other Aw19 alleles (FIG. 8). Theoretically, the peptide pool bound by HLA-A32 would differ from the remaining members of the Aw19 family and would not activate the same subset of responding CD8 T cells. This adds further evidence supporting the hypothesis of the threshold requirement of an increased concentration of the driving autoantigenic peptide pool presented on high-risk HLA-A proteins as a driving component for development of BSCR uveitis.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety.

SEQUENCE LISTING (4755 sequences)

SEQ ID NO: 1 - RNA, 20 nt, Artificial Sequence
  Description of Artificial Sequence: Synthetic oligonucleotide
aucugccuguuugaguuggg

SEQ ID NO: 2 - RNA, 20 nt, Artificial Sequence
  Description of Artificial Sequence: Synthetic oligonucleotide
uaucugccuguuugaguugg

SEQ ID NO: 3 - RNA, 20 nt, Artificial Sequence
  Description of Artificial Sequence: Synthetic oligonucleotide
uuaucugccuguuugaguug

SEQ ID NO: 4 - RNA, 20 nt, Artificial Sequence
  Description of Artificial Sequence: Synthetic oligonucleotide
cuuuaucugccuguuugagu

SEQ ID NO: 5 - RNA, 20 nt, Artificial Sequence
  Description of Artificial Sequence: Synthetic oligonucleotide
ugaucucucuuuaucugccu

SEQ ID NO: 6 - RNA, 20 nt, Artificial Sequence
  Description of Artificial Sequence: Synthetic oligonucleotide
uugaucucucuuuaucugcc

SEQ ID NO: 7 - RNA, 20 nt, Artificial Sequence
  Description of Artificial Sequence: Synthetic oligonucleotide
ucaugcucaucucuuugauc

SEQ ID NO: 8 - RNA, 20 nt, Artificial Sequence
  Description of Artificial Sequence: Synthetic oligonucleotide
cucaugcucaucucuuugau

SEQ ID NO: 9 - RNA, 20 nt, Artificial Sequence
  Description of Artificial Sequence: Synthetic oligonucleotide
ggacuguaucucaugcucau

SEQ ID NO: 10 - RNA, 20 nt, Artificial Sequence
  Description of Artificial Sequence: Synthetic oligonucleotide
gggacuguaucucaugcuca

SEQ ID NO: 11 - RNA, 20 nt, Artificial Sequence
  Description of Artificial Sequence: Synthetic oligonucleotide
cgggcagcuucugugaucuu

SEQ ID NO: 12 - RNA, 20 nt, Artificial Sequence
  Description of Artificial Sequence: Synthetic oligonucleotide
uuuaaucaaacaccucccgg

SEQ ID NO: 13 - RNA, 20 nt, Artificial Sequence
  Description of Artificial Sequence: Synthetic oligonucleotide
auuuaaucaaacaccucccg

SEQ ID NO: 14 - RNA, 20 nt, Artificial Sequence
  Description of Artificial Sequence: Synthetic oligonucleotide
cuccaguuaugucacauggg

SEQ ID NO: 15 - RNA, 20 nt, Artificial Sequence
  Description of Artificial Sequence: Synthetic oligonucleotide
ggcuccaguuaugucacaug

SEQ ID NO: 16 - RNA, 20 nt, Artificial Sequence
  Description of Artificial Sequence: Synthetic oligonucleotide
cuggcuccaguuaugucaca

SEQ ID NO: 17 - RNA, 20 nt, Artificial Sequence
  Description of Artificial Sequence: Synthetic oligonucleotide
aguucuucauggcacugcac

SEQ ID NO: 18 - RNA, 20 nt, Artificial Sequence
  Description of Artificial Sequence: Synthetic oligonucleotide
uaguucuucauggcacugca

SEQ ID NO: 19 - RNA, 20 nt, Artificial Sequence
  Description of Artificial Sequence: Synthetic oligonucleotide
agacaaguuaauauccaggc

SEQ ID NO: 20 - RNA, 20 nt, Artificial Sequence
  Description of Artificial Sequence: Synthetic oligonucleotide
gcagaagaauggaacaugaa

SEQ ID NO: 21 - RNA, 20 nt, Artificial Sequence
  Description of Artificial Sequence: Synthetic oligonucleotide
gugugaauuaaccauugcag

SEQ ID NO: 22 - RNA, 20 nt, Artificial Sequence
  Description of Artificial Sequence: Synthetic oligonucleotide
cugugugaauuaaccauugc

SEQ ID NO: 23 - RNA, 20 nt, Artificial Sequence
  Description of Artificial Sequence: Synthetic oligonucleotide
agcaguaaaauccucuguga

SEQ ID NO: 24 - RNA, 20 nt, Artificial Sequence
  Description of Artificial Sequence: Synthetic oligonucleotide
aagcaguaaaauccucugug

SEQ ID NO: 25 - RNA, 20 nt, Artificial Sequence
  Description of Artificial Sequence: Synthetic oligonucleotide
ggcuguuaagcaguaaaauc

SEQ ID NO: 26 - RNA, 20 nt, Artificial Sequence
  Description of Artificial Sequence: Synthetic oligonucleotide
gauggcuguuaagcaguaaa

SEQ ID NO: 27 - RNA, 20 nt, Artificial Sequence
  Description of Artificial Sequence: Synthetic oligonucleotide
aagauggcuguuaagcagua

SEQ ID NO: 28 - RNA, 20 nt, Artificial Sequence
  Description of Artificial Sequence: Synthetic oligonucleotide
caagauggcuguuaagcagu

SEQ ID NO: 29 - RNA, 20 nt, Artificial Sequence
  Description of Artificial Sequence: Synthetic oligonucleotide
cacugagaacugagaacaaa

SEQ ID NO: 30 - RNA, 20 nt, Artificial Sequence
  Description of Artificial Sequence: Synthetic oligonucleotide
auggcacugagaacugagaa

SEQ ID NO: 31 - RNA, 20 nt, Artificial Sequence
  Description of Artificial Sequence: Synthetic oligonucleotide
gauggcacugagaacugaga

SEQ ID NO: 32 - RNA, 20 nt, Artificial Sequence
  Description of Artificial Sequence: Synthetic oligonucleotide
uagauggcacugagaacuga

SEQ ID NO: 33 - RNA, 20 nt, Artificial Sequence
  Description of Artificial Sequence: Synthetic oligonucleotide
cuagauggcacugagaacug

SEQ ID NO: 34 - RNA, 20 nt, Artificial Sequence
  Description of Artificial Sequence: Synthetic oligonucleotide
gauaacuagauggcacugag

SEQ ID NO: 35 - RNA, 20 nt, Artificial Sequence
  Description of Artificial Sequence: Synthetic oligonucleotide
ugauaacuagauggcacuga

SEQ ID NO: 36 - RNA, 20 nt, Artificial Sequence
  Description of Artificial Sequence: Synthetic oligonucleotide
gugauaacuagauggcacug

SEQ ID NO: 37 - RNA, 20 nt, Artificial Sequence
  Description of Artificial Sequence: Synthetic oligonucleotide
gaagugauaacuagauggca

SEQ ID NO: 38 - RNA, 20 nt, Artificial Sequence
  Description of Artificial Sequence: Synthetic oligonucleotide
ugaagugauaacuagauggc

SEQ ID NO: 39 - RNA, 20 nt, Artificial Sequence
  Description of Artificial Sequence: Synthetic oligonucleotide
gugaagugauaacuagaugg

SEQ ID NO: 40 - RNA, 20 nt, Artificial Sequence
  Description of Artificial Sequence: Synthetic oligonucleotide
cucagugaagugauaacuag

SEQ ID NO: 41 - RNA, 20 nt, Artificial Sequence
  Description of Artificial Sequence: Synthetic oligonucleotide
ccucagugaagugauaacua

SEQ ID NO: 42 - RNA, 20 nt, Artificial Sequence
  Description of Artificial Sequence: Synthetic oligonucleotide
uccucagugaagugauaacu

SEQ ID NO: 43 - RNA, 20 nt, Artificial Sequence
  Description of Artificial Sequence: Synthetic oligonucleotide
gauccucagugaagugauaa

SEQ ID NO: 44 - RNA, 20 nt, Artificial Sequence
  Description of Artificial Sequence: Synthetic oligonucleotide
uuaguggcuacugggaaagc

SEQ ID NO: 45 - RNA, 20 nt, Artificial Sequence
  Description of Artificial Sequence: Synthetic oligonucleotide
auuaguggcuacugggaaag

SEQ ID NO: 46 - RNA, 20 nt, Artificial Sequence
  Description of Artificial Sequence: Synthetic oligonucleotide
cauuaguggcuacugggaaa

SEQ ID NO: 47 - RNA, 20 nt, Artificial Sequence
  Description of Artificial Sequence: Synthetic oligonucleotide
ccauuaguggcuacugggaa

SEQ ID NO: 48 - RNA, 20 nt, Artificial Sequence
  Description of Artificial Sequence: Synthetic oligonucleotide
aucuuaaaucaugcugcugc

SEQ ID NO: 49 - RNA, 20 nt, Artificial Sequence
  Description of Artificial Sequence: Synthetic oligonucleotide
cuccaguuaugucacauggg

SEQ ID NO: 50 - RNA, 20 nt, Artificial Sequence
  Description of Artificial Sequence: Synthetic oligonucleotide
ggcuccaguuaugucacaug

SEQ ID NO: 51 - RNA, 20 nt, Artificial Sequence
  Description of Artificial Sequence: Synthetic oligonucleotide
cuggcuccaguuaugucaca

SEQ ID NO: 52 - RNA, 20 nt, Artificial Sequence
  Description of Artificial Sequence: Synthetic oligonucleotide
aguucuucauggcacugcac

SEQ ID NO: 53 - RNA, 20 nt, Artificial Sequence
  Description of Artificial Sequence: Synthetic oligonucleotide
uaguucuucauggcacugca

SEQ ID NO: 54 - RNA, 20 nt, Artificial Sequence
  Description of Artificial Sequence: Synthetic oligonucleotide
agacaaguuaauauccaggc

SEQ ID NO: 55 - RNA, 20 nt, Artificial Sequence
  Description of Artificial Sequence: Synthetic oligonucleotide
gcagaagaauggaacaugaa

SEQ ID NO: 56 - RNA, 20 nt, Artificial Sequence
  Description of Artificial Sequence: Synthetic oligonucleotide
gugugaauuaaccauugcag

SEQ ID NO: 57 - RNA, 20 nt, Artificial Sequence
  Description of Artificial Sequence: Synthetic oligonucleotide
cugugugaauuaaccauugc

SEQ ID NO: 58 - RNA, 20 nt, Artificial Sequence
  Description of Artificial Sequence: Synthetic oligonucleotide
agcaguaaaauccucuguga

SEQ ID NO: 59 - RNA, 20 nt, Artificial Sequence
  Description of Artificial Sequence: Synthetic oligonucleotide
aagcaguaaaauccucugug

SEQ ID NO: 60 - RNA, 20 nt, Artificial Sequence
  Description of Artificial Sequence: Synthetic oligonucleotide
ggcuguuaagcaguaaaauc

SEQ ID NO: 61 - RNA, 20 nt, Artificial Sequence
  Description of Artificial Sequence: Synthetic oligonucleotide
gauggcuguuaagcaguaaa

SEQ ID NO: 62 - RNA, 20 nt, Artificial Sequence
  Description of Artificial Sequence: Synthetic oligonucleotide
aagauggcuguuaagcagua

SEQ ID NO: 63 - RNA, 20 nt, Artificial Sequence
  Description of Artificial Sequence: Synthetic oligonucleotide
caagauggcuguuaagcagu

SEQ ID NO: 64 - RNA, 20 nt, Artificial Sequence
  Description of Artificial Sequence: Synthetic oligonucleotide
cacugagaacugagaacaaa

SEQ ID NO: 65 - RNA, 20 nt, Artificial Sequence
  Description of Artificial Sequence: Synthetic oligonucleotide
auggcacugagaacugagaa

SEQ ID NO: 66 - RNA, 20 nt, Artificial Sequence
  Description of Artificial Sequence: Synthetic oligonucleotide
gauggcacugagaacugaga

SEQ ID NO: 67 - RNA, 20 nt, Artificial Sequence
  Description of Artificial Sequence: Synthetic oligonucleotide
uagauggcacugagaacuga

SEQ ID NO: 68 - RNA, 20 nt, Artificial Sequence
  Description of Artificial Sequence: Synthetic oligonucleotide
cuagauggcacugagaacug

SEQ ID NO: 69 - RNA, 20 nt, Artificial Sequence
  Description of Artificial Sequence: Synthetic oligonucleotide
gauaacuagauggcacugag

SEQ ID NO: 70 - RNA, 20 nt, Artificial Sequence
  Description of Artificial Sequence: Synthetic oligonucleotide
ugauaacuagauggcacuga

SEQ ID NO: 71 - RNA, 20 nt, Artificial Sequence
  Description of Artificial Sequence: Synthetic oligonucleotide
gugauaacuagauggcacug

SEQ ID NO: 72 - RNA, 20 nt, Artificial Sequence
  Description of Artificial Sequence: Synthetic oligonucleotide
gaagugauaacuagauggca

SEQ ID NO: 73 - RNA, 20 nt, Artificial Sequence
  Description of Artificial Sequence: Synthetic oligonucleotide
ugaagugauaacuagauggc

SEQ ID NO: 74 - RNA, 20 nt, Artificial Sequence
  Description of Artificial Sequence: Synthetic oligonucleotide
gugaagugauaacuagaugg

SEQ ID NO: 75 - RNA, 20 nt, Artificial Sequence
  Description of Artificial Sequence: Synthetic oligonucleotide
cucagugaagugauaacuag

SEQ ID NO: 76 - RNA, 20 nt, Artificial Sequence
  Description of Artificial Sequence: Synthetic oligonucleotide
ccucagugaagugauaacua

SEQ ID NO: 77 - RNA, 20 nt, Artificial Sequence
  Description of Artificial Sequence: Synthetic oligonucleotide
uccucagugaagugauaacu

SEQ ID NO: 78 - RNA, 20 nt, Artificial Sequence
  Description of Artificial Sequence: Synthetic oligonucleotide
gauccucagugaagugauaa

SEQ ID NO: 79 - RNA, 20 nt, Artificial Sequence
  Description of Artificial Sequence: Synthetic oligonucleotide
uuaguggcuacugggaaagc

SEQ ID NO: 80 - RNA, 20 nt, Artificial Sequence
  Description of Artificial Sequence: Synthetic oligonucleotide
auuaguggcuacugggaaag

SEQ ID NO: 81 - RNA, 20 nt, Artificial Sequence
  Description of Artificial Sequence: Synthetic oligonucleotide
cauuaguggcuacugggaaa

SEQ ID NO: 82 - RNA, 20 nt, Artificial Sequence
  Description of Artificial Sequence: Synthetic oligonucleotide
ccauuaguggcuacugggaa

SEQ ID NO: 83 - RNA, 20 nt, Artificial Sequence
  Description of Artificial Sequence: Synthetic oligonucleotide
uaauggagaggaaugaccac

SEQ ID NO: 84 - RNA, 20 nt, Artificial Sequence
  Description of Artificial Sequence: Synthetic oligonucleotide
auaauggagaggaaugacca

SEQ ID NO: 85 - RNA, 20 nt, Artificial Sequence
  Description of Artificial Sequence: Synthetic oligonucleotide
agaggucauaauggagagga

SEQ ID NO: 86 - RNA, 20 nt, Artificial Sequence
  Description of Artificial Sequence: Synthetic oligonucleotide
aagaggucauaauggagagg

SEQ ID NO: 87 - RNA, 20 nt, Artificial Sequence
  Description of Artificial Sequence: Synthetic oligonucleotide
aaagaggucauaauggagag

SEQ ID NO: 88 - RNA, 20 nt, Artificial Sequence
  Description of Artificial Sequence: Synthetic oligonucleotide
caaagaggucauaauggaga

SEQ ID NO: 89 - RNA, 20 nt, Artificial Sequence
  Description of Artificial Sequence: Synthetic oligonucleotide
acaaagaggucauaauggag

SEQ ID NO: 90 - RNA, 20 nt, Artificial Sequence
  Description of Artificial Sequence: Synthetic oligonucleotide
ggacaaagaggucauaaugg

SEQ ID NO: 91 - RNA, 20 nt, Artificial Sequence
  Description of Artificial Sequence: Synthetic oligonucleotide
aaaguccagagaggugagau

SEQ ID NO: 92 - RNA, 20 nt, Artificial Sequence
  Description of Artificial Sequence: Synthetic oligonucleotide
caaaguccagagaggugaga

SEQ ID NO: 93 - RNA, 20 nt, Artificial Sequence
  Description of Artificial Sequence: Synthetic oligonucleotide
augcaacaaaguccagagag

SEQ ID NO: 94 - RNA, 20 nt, Artificial Sequence
  Description of Artificial Sequence: Synthetic oligonucleotide
gaugcaacaaaguccagaga

SEQ ID NO: 95 - RNA, 20 nt, Artificial Sequence
  Description of Artificial Sequence: Synthetic oligonucleotide
agaugcaacaaaguccagag

SEQ ID NO: 96 - RNA, 20 nt, Artificial Sequence
  Description of Artificial Sequence: Synthetic oligonucleotide
cucagaugcaacaaagucca

SEQ ID NO: 97 - RNA, 20 nt, Artificial Sequence
  Description of Artificial Sequence: Synthetic oligonucleotide
uucucagaugcaacaaaguc

SEQ ID NO: 98 - RNA, 20 nt, Artificial Sequence
  Description of Artificial Sequence: Synthetic oligonucleotide
cuucucagaugcaacaaagu

SEQ ID NO: 99 - RNA, 20 nt, Artificial Sequence
  Description of Artificial Sequence: Synthetic oligonucleotide
agcauugcugaccaagacuu

SEQ ID NO: 100 - RNA, 20 nt, Artificial Sequence
  Description of Artificial Sequence: Synthetic oligonucleotide
uagcauugcugaccaagacu

SEQ ID NO: 101 - RNA, 20 nt, Artificial Sequence
  Description of Artificial Sequence: Synthetic oligonucleotide
guagcauugcugaccaagac

SEQ ID NO: 102 - RNA, 20 nt, Artificial Sequence
  Description of Artificial Sequence: Synthetic oligonucleotide
gguagcauugcugaccaaga

SEQ ID NO: 103 - RNA, 20 nt, Artificial Sequence
  Description of Artificial Sequence: Synthetic oligonucleotide
ggguagcauugcugaccaag

SEQ ID NO: 104 - RNA, 20 nt, Artificial Sequence
  Description of Artificial Sequence: Synthetic oligonucleotide
uggguagcauugcugaccaa

SEQ ID NO: 105 - RNA, 20 nt, Artificial Sequence
  Description of Artificial Sequence: Synthetic oligonucleotide
aaacuggguagcauugcuga

SEQ ID NO: 106 - RNA, 20 nt, Artificial Sequence
  Description of Artificial Sequence: Synthetic oligonucleotide
uaaacuggguagcauugcug

SEQ ID NO: 107 - RNA, 20 nt, Artificial Sequence
  Description of Artificial Sequence: Synthetic oligonucleotide
ugauaaacuggguagcauug

SEQ ID NO: 108 - RNA, 20 nt, Artificial Sequence
  Description of Artificial Sequence: Synthetic oligonucleotide
agaugauaaacuggguagca

SEQ ID NO: 109 - RNA, 20 nt, Artificial Sequence
  Description of Artificial Sequence: Synthetic oligonucleotide
aagaugauaaacuggguagc

SEQ ID NO: 110 - RNA, 20 nt, Artificial Sequence
  Description of Artificial Sequence: Synthetic oligonucleotide
caagaugauaaacuggguag

SEQ ID NO: 111 - RNA, 20 nt, Artificial Sequence
  Description of Artificial Sequence: Synthetic oligonucleotide
gcaagaugauaaacugggua

SEQ ID NO: 112 - RNA, 20 nt, Artificial Sequence
  Description of Artificial Sequence: Synthetic oligonucleotide
gugcaagaugauaaacuggg

SEQ ID NO: 113 - RNA, 20 nt, Artificial Sequence
  Description of Artificial Sequence: Synthetic oligonucleotide
ugugcaagaugauaaacugg

SEQ ID NO: 114 - RNA, 20 nt, Artificial Sequence
  Description of Artificial Sequence: Synthetic oligonucleotide
cugugcaagaugauaaacug

SEQ ID NO: 115 - RNA, 20 nt, Artificial Sequence
  Description of Artificial Sequence: Synthetic oligonucleotide
gcugugcaagaugauaaacu

SEQ ID NO: 116 - RNA, 20 nt, Artificial Sequence
  Description of Artificial Sequence: Synthetic oligonucleotide
ggcauucgugauuucaagau

SEQ ID NO: 117 - RNA, 20 nt, Artificial Sequence
  Description of Artificial Sequence: Synthetic oligonucleotide
uggcauucgugauuucaaga

SEQ ID NO: 118 - RNA, 20 nt, Artificial Sequence
  Description of Artificial Sequence: Synthetic oligonucleotide
guggcauucgugauuucaag

SEQ ID NO: 119 - RNA, 20 nt, Artificial Sequence
  Description of Artificial Sequence: Synthetic oligonucleotide
gguggcauucgugauuucaa

SEQ ID NO: 120 - RNA, 20 nt, Artificial Sequence
  Description of Artificial Sequence: Synthetic oligonucleotide
ggguggcauucgugauuuca

SEQ ID NO: 121 - RNA, 20 nt, Artificial Sequence
  Description of Artificial Sequence: Synthetic oligonucleotide
aggguggcauucgugauuuc

SEQ ID NO: 122 - RNA, 20 nt, Artificial Sequence
  Description of Artificial Sequence: Synthetic oligonucleotide
aaggguggcauucgugauuu

SEQ ID NO: 123 - RNA, 20 nt, Artificial Sequence
  Description of Artificial Sequence: Synthetic oligonucleotide
cugaaggguggcauucguga

SEQ ID NO: 124 - RNA, 20 nt, Artificial Sequence
  Description of Artificial Sequence: Synthetic oligonucleotide
acugaaggguggcauucgug

SEQ ID NO: 125 - RNA, 20 nt, Artificial Sequence
  Description of Artificial Sequence: Synthetic oligonucleotide
gacugaaggguggcauucgu

SEQ ID NO: 126 - RNA, 20 nt, Artificial Sequence
  Description of Artificial Sequence: Synthetic oligonucleotide
ugacugaaggguggcauucg

SEQ ID NO: 127 - RNA, 20 nt, Artificial Sequence
  Description of Artificial Sequence: Synthetic oligonucleotide
cugacugaaggguggcauuc

SEQ ID NO: 128 - RNA, 20 nt, Artificial Sequence
  Description of Artificial Sequence: Synthetic oligonucleotide
ucugacugaaggguggcauu

SEQ ID NO: 129 - RNA, 20 nt, Artificial Sequence
  Description of Artificial Sequence: Synthetic oligonucleotide
cucugacugaaggguggcau

SEQ ID NO: 130 - RNA, 20 nt, Artificial Sequence
  Description of Artificial Sequence: Synthetic oligonucleotide
ccucugacugaaggguggca

SEQ ID NO: 131 - RNA, 20 nt, Artificial Sequence
  Description of Artificial Sequence: Synthetic oligonucleotide
uccucugacugaaggguggc

SEQ ID NO: 132 - RNA, 20 nt, Artificial Sequence
  Description of Artificial Sequence: Synthetic oligonucleotide
uuccucugacugaagggugg

SEQ ID NO: 133 - RNA, 20 nt, Artificial Sequence
  Description of Artificial Sequence: Synthetic oligonucleotide
uugaaucuuccucugacuga

SEQ ID NO: 134 - RNA, 20 nt, Artificial Sequence
  Description of Artificial Sequence: Synthetic oligonucleotide
cuugaaucuuccucugacug

SEQ ID NO: 135 - RNA, 20 nt, Artificial Sequence
  Description of Artificial Sequence: Synthetic oligonucleotide
ucuugaaucuuccucugacu

SEQ ID NO: 136 - RNA, 20 nt, Artificial Sequence
  Description of Artificial Sequence: Synthetic oligonucleotide
guaucuugaaucuuccucug

SEQ ID NO: 137 - RNA, 20 nt, Artificial Sequence
  Description of Artificial Sequence: Synthetic oligonucleotide
uccugguuucauguaucuug

SEQ ID NO: 138 - RNA, 20 nt, Artificial Sequence
  Description of Artificial Sequence: Synthetic oligonucleotide
gcaggguaacucaaaacuuu

SEQ ID NO: 139 - RNA, 20 nt, Artificial Sequence
  Description of Artificial Sequence: Synthetic oligonucleotide
agcaggguaacucaaaacuu

SEQ ID NO: 140 - RNA, 20 nt, Artificial Sequence
  Description of Artificial Sequence: Synthetic oligonucleotide
gagcaggguaacucaaaacu

SEQ ID NO: 141 - RNA, 20 nt, Artificial Sequence
  Description of Artificial Sequence: Synthetic oligonucleotide
agcagugcaauuuguucaug

SEQ ID NO: 142 - RNA, 20 nt, Artificial Sequence
  Description of Artificial Sequence: Synthetic oligonucleotide
cagcagugcaauuuguucau

SEQ ID NO: 143 - RNA, 20 nt, Artificial Sequence
  Description of Artificial Sequence: Synthetic oligonucleotide
ccagcagugcaauuuguuca

SEQ ID NO: 144 - RNA, 20 nt, Artificial Sequence
  Description of Artificial Sequence: Synthetic oligonucleotide
accagcagugcaauuuguuc

SEQ ID NO: 145 - RNA, 20 nt, Artificial Sequence
  Description of Artificial Sequence: Synthetic oligonucleotide
aaccagcagugcaauuuguu

SEQ ID NO: 146 - RNA, 20 nt, Artificial Sequence
  Description of Artificial Sequence: Synthetic oligonucleotide
gaaccagcagugcaauuugu

SEQ ID NO: 147 - RNA, 20 nt, Artificial Sequence
  Description of Artificial Sequence: Synthetic oligonucleotide
ggaaccagcagugcaauuug

SEQ ID NO: 148 - RNA, 20 nt, Artificial Sequence
  Description of Artificial Sequence: Synthetic oligonucleotide
ucuggaaccagcagugcaau

SEQ ID NO: 149 - RNA, 20 nt, Artificial Sequence
  Description of Artificial Sequence: Synthetic oligonucleotide
ucucuggaaccagcagugca

SEQ ID NO: 150 - RNA, 20 nt, Artificial Sequence
  Description of Artificial Sequence: Synthetic oligonucleotide
uucucuggaaccagcagugc

SEQ ID NO: 151 - RNA, 20 nt, Artificial Sequence
  Description of Artificial Sequence: Synthetic oligonucleotide
uuucucuggaaccagcagug

SEQ ID NO: 152 - RNA, 20 nt, Artificial Sequence
  Description of Artificial Sequence: Synthetic oligonucleotide
cguaaguuucucuggaacca

SEQ ID NO: 153 - RNA, 20 nt, Artificial Sequence
  Description of Artificial Sequence: Synthetic oligonucleotide
gcguaaguuucucuggaacc

SEQ ID NO: 154 - RNA, 20 nt, Artificial Sequence
  Description of Artificial Sequence: Synthetic oligonucleotide
ggcguaaguuucucuggaac

SEQ ID NO: 155 - RNA, 20 nt, Artificial Sequence
  Description of Artificial Sequence: Synthetic oligonucleotide
aggcguaaguuucucuggaa

SEQ ID NO: 156 - RNA, 20 nt, Artificial Sequence
  Description of Artificial Sequence: Synthetic oligonucleotide
gaggcguaaguuucucugga

SEQ ID NO: 157 - RNA, 20 nt, Artificial Sequence
  Description of Artificial Sequence: Synthetic oligonucleotide
ugaggcguaaguuucucugg

SEQ ID NO: 158 - RNA, 20 nt, Artificial Sequence
  Description of Artificial Sequence: Synthetic oligonucleotide
gugaggcguaaguuucucug

SEQ ID NO: 159 - RNA, 20 nt, Artificial Sequence
  Description of Artificial Sequence: Synthetic oligonucleotide
ggugaggcguaaguuucucu

SEQ ID NO: 160 - RNA, 20 nt, Artificial Sequence
  Description of Artificial Sequence: Synthetic oligonucleotide
aggugaggcguaaguuucuc

SEQ ID NO: 161 - RNA, 20 nt, Artificial Sequence
  Description of Artificial Sequence: Synthetic oligonucleotide
caggugaggcguaaguuucu

SEQ ID NO: 162 - RNA, 20 nt, Artificial Sequence
  Description of Artificial Sequence: Synthetic oligonucleotide
ucaggugaggcguaaguuuc

SEQ ID NO: 163 - RNA, 20 nt, Artificial Sequence
  Description of Artificial Sequence: Synthetic oligonucleotide
uucaggugaggcguaaguuu

SEQ ID NO: 164 - RNA, 20 nt, Artificial Sequence
  Description of Artificial Sequence: Synthetic oligonucleotide
uuucaggugaggcguaaguu

SEQ ID NO: 165 - RNA, 20 nt, Artificial Sequence
  Description of Artificial Sequence: Synthetic oligonucleotide
auuucaggugaggcguaagu

SEQ ID NO: 166 - RNA, 20 nt, Artificial Sequence
  Description of Artificial Sequence: Synthetic oligonucleotide
uauuucaggugaggcguaag

SEQ ID NO: 167 - RNA, 20 nt, Artificial Sequence
  Description of Artificial Sequence: Synthetic oligonucleotide
guauuucaggugaggcguaa

SEQ ID NO: 168 - RNA, 20 nt, Artificial Sequence
  Description of Artificial Sequence: Synthetic oligonucleotide
aguauuucaggugaggcgua

SEQ ID NO: 169 - RNA, 20 nt, Artificial Sequence
  Description of Artificial Sequence: Synthetic oligonucleotide
auaguauuucaggugaggcg

SEQ ID NO: 170 - RNA, 20 nt, Artificial Sequence
  Description of Artificial Sequence: Synthetic oligonucleotide
cauaguauuucaggugaggc

SEQ ID NO: 171 - RNA, 20 nt, Artificial Sequence
  Description of Artificial Sequence: Synthetic oligonucleotide
cacauaguauuucaggugag

SEQ ID NO: 172 - RNA, 20 nt, Artificial Sequence
  Description of Artificial Sequence: Synthetic oligonucleotide
agccacauaguauuucaggu

SEQ ID NO: 173 - RNA, 20 nt, Artificial Sequence
  Description of Artificial Sequence: Synthetic oligonucleotide
uagccacauaguauuucagg

SEQ ID NO: 174 - RNA, 20 nt, Artificial Sequence
  Description of Artificial Sequence: Synthetic oligonucleotide
ccauagccacauaguauuuc

SEQ ID NO: 175 - RNA, 20 nt, Artificial Sequence
  Description of Artificial Sequence: Synthetic oligonucleotide
aguccauagccacauaguau

SEQ ID NO: 176 - RNA, 20 nt, Artificial Sequence
  Description of Artificial Sequence: Synthetic oligonucleotide
aaguccauagccacauagua

SEQ ID NO: 177 - RNA, 20 nt, Artificial Sequence
  Description of Artificial Sequence: Synthetic oligonucleotide
gaaguccauagccacauagu

SEQ ID NO: 178 - RNA, 20 nt, Artificial Sequence
  Description of Artificial Sequence: Synthetic oligonucleotide
ggaaguccauagccacauag

SEQ ID NO: 179 - RNA, 20 nt, Artificial Sequence
  Description of Artificial Sequence: Synthetic oligonucleotide
uggaaguccauagccacaua

SEQ ID NO: 180 - RNA, 20 nt, Artificial Sequence
  Description of Artificial Sequence: Synthetic oligonucleotide
gcuuggaaguccauagccac

SEQ ID NO: 181 - RNA, 20 nt, Artificial Sequence
  Description of Artificial Sequence: Synthetic oligonucleotide
uuggcuuggaaguccauagc

SEQ ID NO: 182 - RNA, 20 nt, Artificial Sequence
  Description of Artificial Sequence: Synthetic oligonucleotide
caccuaacuuggcuuggaag

SEQ ID NO: 183 - RNA, 20 nt, Artificial Sequence
  Description of Artificial Sequence: Synthetic oligonucleotide
aucaccuaacuuggcuugga

SEQ ID NO: 184 - RNA, 20 nt, Artificial Sequence
  Description of Artificial Sequence: Synthetic oligonucleotide
caucaccuaacuuggcuugg

SEQ ID NO: 185 - RNA, 20 nt, Artificial Sequence
  Description of Artificial Sequence: Synthetic oligonucleotide
ccaucaccuaacuuggcuug

SEQ ID NO: 186 - RNA, 20 nt, Artificial Sequence
  Description of Artificial Sequence: Synthetic oligonucleotide
caaagccaucaccuaacuug

SEQ ID NO: 187 - RNA, 20 nt, Artificial Sequence
  Description of Artificial Sequence: Synthetic oligonucleotide
ucaaagccaucaccuaacuu

SEQ ID NO: 188 - RNA, 20 nt, Artificial Sequence
  Description of Artificial Sequence: Synthetic oligonucleotide
uucaaagccaucaccuaacu

SEQ ID NO: 189 - RNA, 20 nt, Artificial Sequence
  Description of Artificial Sequence: Synthetic oligonucleotide
cuucaaagccaucaccuaac

SEQ ID NO: 190 - RNA, 20 nt, Artificial Sequence
  Description of Artificial Sequence: Synthetic oligonucleotide
acccuucaaagccaucaccu

SEQ ID NO: 191 - RNA, 20 nt, Artificial Sequence
  Description of Artificial Sequence: Synthetic oligonucleotide
aacccuucaaagccaucacc

SEQ ID NO: 192 - RNA, 20 nt, Artificial Sequence
  Description of Artificial Sequence: Synthetic oligonucleotide
caagaguucuguaugugcuu

SEQ ID NO: 193 - RNA, 20 nt, Artificial Sequence
  Description of Artificial Sequence: Synthetic oligonucleotide
ccaagaguucuguaugugcu

SEQ ID NO: 194 - RNA, 20 nt, Artificial Sequence
  Description of Artificial Sequence: Synthetic oligonucleotide
accaagaguucuguaugugc

SEQ ID NO: 195 - RNA, 20 nt, Artificial Sequence
  Description of Artificial Sequence: Synthetic oligonucleotide
caccaagaguucuguaugug

SEQ ID NO: 196 - RNA, 20 nt, Artificial Sequence
  Description of Artificial Sequence: Synthetic oligonucleotide
ccaccaagaguucuguaugu

SEQ ID NO: 197 - RNA, 20 nt, Artificial Sequence
  Description of Artificial Sequence: Synthetic oligonucleotide
accaccaagaguucuguaug

SEQ ID NO: 198 - RNA, 20 nt, Artificial Sequence
  Description of Artificial Sequence: Synthetic oligonucleotide
ggcucaaaaucuguuacugc

SEQ ID NO: 199 - RNA, 20 nt, Artificial Sequence
  Description of Artificial Sequence: Synthetic oligonucleotide
uggcucaaaaucuguuacug

SEQ ID NO: 200 - RNA, 20 nt, Artificial Sequence
  Description of Artificial Sequence: Synthetic oligonucleotide
uggguuggcucaaaaucugu

SEQ ID NO: 201 - RNA, 20 nt, Artificial Sequence
  Description of Artificial Sequence: Synthetic oligonucleotide
cuggguuggcucaaaaucug

SEQ ID NO: 202 - RNA, 20 nt, Artificial Sequence
  Description of Artificial Sequence: Synthetic oligonucleotide
ccuggguuggcucaaaaucu

SEQ ID NO: 203 - RNA, 20 nt, Artificial Sequence
  Description of Artificial Sequence: Synthetic oligonucleotide
ugccuggguuggcucaaaau

SEQ ID NO: 204 - RNA, 20 nt, Artificial Sequence
  Description of Artificial Sequence: Synthetic oligonucleotide
gugccuggguuggcucaaaa

SEQ ID NO: 205 - RNA, 20 nt, Artificial Sequence
  Description of Artificial Sequence: Synthetic oligonucleotide
cgugccuggguuggcucaaa

SEQ ID NO: 206 - RNA, 20 nt, Artificial Sequence
  Description of Artificial Sequence: Synthetic oligonucleotide
aagccaugcgugccuggguu

SEQ ID NO: 207 - RNA, 20 nt, Artificial Sequence
  Description of Artificial Sequence: Synthetic oligonucleotide
aaagccaugcgugccugggu

SEQ ID NO: 208 - RNA, 20 nt, Artificial Sequence
  Description of Artificial Sequence: Synthetic oligonucleotide
agggaaagccaugcgugccu

SEQ ID NO: 209 - RNA, 20 nt, Artificial Sequence
  Description of Artificial Sequence: Synthetic oligonucleotide
aagggaaagccaugcgugcc

SEQ ID NO: 210 - RNA, 20 nt, Artificial Sequence
  Description of Artificial Sequence: Synthetic oligonucleotide
gcaagggaaagccaugcgug

SEQ ID NO: 211 - RNA, 20 nt, Artificial Sequence
  Description of Artificial Sequence: Synthetic oligonucleotide
aagcaagggaaagccaugcg

SEQ ID NO: 212 - RNA, 20 nt, Artificial Sequence
  Description of Artificial Sequence: Synthetic oligonucleotide
caaagcaagggaaagccaug

SEQ ID NO: 213 - RNA, 20 nt, Artificial Sequence
  Description of Artificial Sequence: Synthetic oligonucleotide
caucaaagcaagggaaagcc

SEQ ID NO: 214 - RNA, 20 nt, Artificial Sequence
  Description of Artificial Sequence: Synthetic oligonucleotide
guucaucaaagcaagggaaa

SEQ ID NO: 215 - RNA, 20 nt, Artificial Sequence
  Description of Artificial Sequence: Synthetic oligonucleotide
cucucuucguaucuugauug

SEQ ID NO: 216 - RNA, 20 nt, Artificial Sequence
  Description of Artificial Sequence: Synthetic oligonucleotide
gcucucucuucguaucuuga

SEQ ID NO: 217 - RNA, 20 nt, Artificial Sequence
  Description of Artificial Sequence: Synthetic oligonucleotide
ccugcucucucuucguaucu

SEQ ID NO: 218 - RNA, 20 nt, Artificial Sequence
  Description of Artificial Sequence: Synthetic oligonucleotide
gccugcucucucuucguauc

SEQ ID NO: 219 - RNA, 20 nt, Artificial Sequence
  Description of Artificial Sequence: Synthetic oligonucleotide
gugcaauaugccugcucucu

SEQ ID NO: 220 - RNA, 20 nt, Artificial Sequence
  Description of Artificial Sequence: Synthetic oligonucleotide
agugcaauaugccugcucuc

SEQ ID NO: 221 - RNA, 20 nt, Artificial Sequence
  Description of Artificial Sequence: Synthetic oligonucleotide
uagugcaauaugccugcucu

SEQ ID NO: 222 - RNA, 20 nt, Artificial Sequence
  Description of Artificial Sequence: Synthetic oligonucleotide
auagugcaauaugccugcuc

SEQ ID NO: 223 - RNA, 20 nt, Artificial Sequence
  Description of Artificial Sequence: Synthetic oligonucleotide
uggauagugcaauaugccug

SEQ ID NO: 224 - RNA, 20 nt, Artificial Sequence
  Description of Artificial Sequence: Synthetic oligonucleotide
uuggauagugcaauaugccu

SEQ ID NO: 225 - RNA, 20 nt, Artificial Sequence
  Description of Artificial Sequence: Synthetic oligonucleotide
guuggauagugcaauaugcc

SEQ ID NO: 226 - RNA, 20 nt, Artificial Sequence
  Description of Artificial Sequence: Synthetic oligonucleotide
uguuggauagugcaauaugc

SEQ ID NO: 227 - RNA, 20 nt, Artificial Sequence
  Description of Artificial Sequence: Synthetic oligonucleotide
gcauguuggauagugcaaua

SEQ ID NO: 228 - RNA, 20 nt, Artificial Sequence
  Description of Artificial Sequence: Synthetic oligonucleotide
ggcauguuggauagugcaau

SEQ ID NO: 229 - RNA, 20 nt, Artificial Sequence
  Description of Artificial Sequence: Synthetic oligonucleotide
uggcauguuggauagugcaa

SEQ ID NO: 230 - RNA, 20 nt, Artificial Sequence
  Description of Artificial Sequence: Synthetic oligonucleotide
uuggcauguuggauagugca

SEQ ID NO: 231 - RNA, 20 nt, Artificial Sequence
  Description of Artificial Sequence: Synthetic oligonucleotide
uuuggcauguuggauagugc

SEQ ID NO: 232 - RNA, 20 nt, Artificial Sequence
  Description of Artificial Sequence: Synthetic oligonucleotide
cuuuggcauguuggauagug

SEQ ID NO: 233 - RNA, 20 nt, Artificial Sequence
  Description of Artificial Sequence: Synthetic oligonucleotide
gaccuccuucaaguucaauu

SEQ ID NO: 234 - RNA, 20 nt, Artificial Sequence
  Description of Artificial Sequence: Synthetic oligonucleotide
caaaagaccuccuucaaguu

SEQ ID NO: 235 - RNA, 20 nt, Artificial Sequence
  Description of Artificial Sequence: Synthetic oligonucleotide
uccaaaagaccuccuucaag

SEQ ID NO: 236 - RNA, 20 nt, Artificial Sequence
  Description of Artificial Sequence: Synthetic oligonucleotide
cuuccaaaagaccuccuuca

SEQ ID NO: 237 - RNA, 20 nt, Artificial Sequence
  Description of Artificial Sequence: Synthetic oligonucleotide
ucacaaacuauguaggcuac

SEQ ID NO: 238 - RNA, 20 nt, Artificial Sequence
  Description of Artificial Sequence: Synthetic oligonucleotide
agagaguggaaaucacaaac

SEQ ID NO: 239 - RNA, 20 nt, Artificial Sequence
  Description of Artificial Sequence: Synthetic oligonucleotide
ucagagaguggaaaucacaa

SEQ ID NO: 240 - RNA, 20 nt, Artificial Sequence
  Description of Artificial Sequence: Synthetic oligonucleotide
cccugaugaagugaagccac

SEQ ID NO: 241 - RNA, 20 nt, Artificial Sequence
  Description of Artificial Sequence: Synthetic oligonucleotide
auagauggacaccuugaccc

SEQ ID NO: 242 - RNA, 20 nt, Artificial Sequence
  Description of Artificial Sequence: Synthetic oligonucleotide
cauagauggacaccuugacc

SEQ ID NO: 243 - RNA, 20 nt, Artificial Sequence
  Description of Artificial Sequence: Synthetic oligonucleotide
gcauagauggacaccuugac

SEQ ID NO: 244 - RNA, 20 nt, Artificial Sequence
  Description of Artificial Sequence: Synthetic oligonucleotide
ugcauagauggacaccuuga

SEQ ID NO: 245 - RNA, 20 nt, Artificial Sequence
  Description of Artificial Sequence: Synthetic oligonucleotide
uuugauuccguuugucuggg

SEQ ID NO: 246 - RNA, 20 nt, Artificial Sequence
  Description of Artificial Sequence: Synthetic oligonucleotide
guuugauuccguuugucugg

SEQ ID NO: 247 - RNA, 20 nt, Artificial Sequence
  Description of Artificial Sequence: Synthetic oligonucleotide
uguuugauuccguuugucug

SEQ ID NO: 248 - RNA, 20 nt, Artificial Sequence
  Description of Artificial Sequence: Synthetic oligonucleotide
guguuugauuccguuugucu

SEQ ID NO: 249 - RNA, 20 nt, Artificial Sequence
  Description of Artificial Sequence: Synthetic oligonucleotide
gcauaauguguuugauuccg

SEQ ID NO: 250 - RNA, 20 nt, Artificial Sequence
  Description of Artificial Sequence: Synthetic oligonucleotide
ucagugaugccugcaaagca

SEQ ID NO: 251 - RNA, 20 nt, Artificial Sequence
  Description of Artificial Sequence: Synthetic oligonucleotide
guagcuucagugaugccugc

SEQ ID NO: 252 - RNA, 20 nt, Artificial Sequence
  Description of Artificial Sequence: Synthetic oligonucleotide
aguagcuucagugaugccug

SEQ ID NO: 253 - RNA, 20 nt, Artificial Sequence
  Description of Artificial Sequence: Synthetic oligonucleotide
ggagaguggauaguagauau

SEQ ID NO: 254 - RNA, 20 nt, Artificial Sequence
  Description of Artificial Sequence: Synthetic oligonucleotide
uggagaguggauaguagaua

SEQ ID NO: 255 - RNA, 20 nt, Artificial Sequence
  Description of Artificial Sequence: Synthetic oligonucleotide
uuggagaguggauaguagau

SEQ ID NO: 256 - RNA, 20 nt, Artificial Sequence
  Description of Artificial Sequence: Synthetic oligonucleotide
uuuggagaguggauaguaga

SEQ ID NO: 257 - RNA, 20 nt, Artificial Sequence
  Description of Artificial Sequence: Synthetic oligonucleotide
guuuggagaguggauaguag

SEQ ID NO: 258 - RNA, 20 nt, Artificial Sequence
  Description of Artificial Sequence: Synthetic oligonucleotide
caguuuggagaguggauagu

SEQ ID NO: 259 - RNA, 20 nt, Artificial Sequence
  Description of Artificial Sequence: Synthetic oligonucleotide
gcaaagucaggaauagcaau

SEQ ID NO: 260 - RNA, 20 nt, Artificial Sequence
  Description of Artificial Sequence: Synthetic oligonucleotide
ugcaaagucaggaauagcaa

SEQ ID NO: 261 - RNA, 20 nt, Artificial Sequence
  Description of Artificial Sequence: Synthetic oligonucleotide
gugcaaagucaggaauagca

SEQ ID NO: 262 - RNA, 20 nt, Artificial Sequence
  Description of Artificial Sequence: Synthetic oligonucleotide
ggugcaaagucaggaauagc

SEQ ID NO: 263 - RNA, 20 nt, Artificial Sequence
  Description of Artificial Sequence: Synthetic oligonucleotide
aggugcaaagucaggaauag

SEQ ID NO: 264 - RNA, 20 nt, Artificial Sequence
  Description of Artificial Sequence: Synthetic oligonucleotide
caggugcaaagucaggaaua

SEQ ID NO: 265 - RNA, 20 nt, Artificial Sequence
  Description of Artificial Sequence: Synthetic oligonucleotide
ccaggugcaaagucaggaau

SEQ ID NO: 266 - RNA, 20 nt, Artificial Sequence
  Description of Artificial Sequence: Synthetic oligonucleotide
uccaggugcaaagucaggaa

SEQ ID NO: 267 - RNA, 20 nt, Artificial Sequence
  Description of Artificial Sequence: Synthetic oligonucleotide
cuccaggugcaaagucagga

SEQ ID NO: 268 - RNA, 20 nt, Artificial Sequence
  Description of Artificial Sequence: Synthetic oligonucleotide
gcuccaggugcaaagucagg

SEQ ID NO: 269 - RNA, 20 nt, Artificial Sequence
  Description of Artificial Sequence: Synthetic oligonucleotide
ggcuccaggugcaaagucag

SEQ ID NO: 270 - RNA, 20 nt, Artificial Sequence
  Description of Artificial Sequence: Synthetic oligonucleotide
cucccuauauguaaugaggc

SEQ ID NO: 271 - RNA, 20 nt, Artificial Sequence
  Description of Artificial Sequence: Synthetic oligonucleotide
ggaagcagaagaggucuugg

SEQ ID NO: 272 - RNA, 20 nt, Artificial Sequence
  Description of Artificial Sequence: Synthetic oligonucleotide
cggaagcagaagaggucuug

SEQ ID NO: 273 - RNA, 20 nt, Artificial Sequence
  Description of Artificial Sequence: Synthetic oligonucleotide
ucggaagcagaagaggucuu

SEQ ID NO: 274 - RNA, 20 nt, Artificial Sequence
  Description of Artificial Sequence: Synthetic oligonucleotide
aucggaagcagaagaggucu

SEQ ID NO: 275 - RNA, 20 nt, Artificial Sequence
  Description of Artificial Sequence: Synthetic oligonucleotide
uaucggaagcagaagagguc

SEQ ID NO: 276 - RNA, 20 nt, Artificial Sequence
  Description of Artificial Sequence: Synthetic oligonucleotide
uuaucggaagcagaagaggu

SEQ ID NO: 277 - RNA, 20 nt, Artificial Sequence
  Description of Artificial Sequence: Synthetic oligonucleotide
uuuaucggaagcagaagagg

SEQ ID NO: 278 - RNA, 20 nt, Artificial Sequence
  Description of Artificial Sequence: Synthetic oligonucleotide
guuuaucggaagcagaagag

SEQ ID NO: 279 - RNA, 20 nt, Artificial Sequence
  Description of Artificial Sequence: Synthetic oligonucleotide
aguuuaucggaagcagaaga

SEQ ID NO: 280 - RNA, 20 nt, Artificial Sequence
  Description of Artificial Sequence: Synthetic oligonucleotide
caguuuaucggaagcagaag

SEQ ID NO: 281 - RNA, 20 nt, Artificial Sequence
  Description of Artificial Sequence: Synthetic oligonucleotide
ccacaguuuaucggaagcag

SEQ ID NO: 282 - RNA, 20 nt, Artificial Sequence
  Description of Artificial Sequence: Synthetic oligonucleotide
cccacaguuuaucggaagca

SEQ ID NO: 283 - RNA, 20 nt, Artificial Sequence
  Description of Artificial Sequence: Synthetic oligonucleotide
acccacaguuuaucggaagc

SEQ ID NO: 284 - RNA, 20 nt, Artificial Sequence
  Description of Artificial Sequence: Synthetic oligonucleotide
gacccacaguuuaucggaag

SEQ ID NO: 285 - RNA, 20 nt, Artificial Sequence
  Description of Artificial Sequence: Synthetic oligonucleotide
ugacccacaguuuaucggaa

SEQ ID NO: 286 - RNA, 20 nt, Artificial Sequence
  Description of Artificial Sequence: Synthetic oligonucleotide
gugacccacaguuuaucgga

SEQ ID NO: 287 - RNA, 20 nt, Artificial Sequence
  Description of Artificial Sequence: Synthetic oligonucleotide
ggugacccacaguuuaucgg

SEQ ID NO: 288 - RNA, 20 nt, Artificial Sequence
  Description of Artificial Sequence: Synthetic oligonucleotide
uggugacccacaguuuaucg

SEQ ID NO: 289 - RNA, 20 nt, Artificial Sequence
  Description of Artificial Sequence: Synthetic oligonucleotide
cuggugacccacaguuuauc

SEQ ID NO: 290 - RNA, 20 nt, Artificial Sequence
  Description of Artificial Sequence: Synthetic oligonucleotide
cucuggugacccacaguuua

SEQ ID NO: 291 - RNA, 20 nt, Artificial Sequence
  Description of Artificial Sequence: Synthetic oligonucleotide
acucuggugacccacaguuu

SEQ ID NO: 292 - RNA, 20 nt, Artificial Sequence
  Description of Artificial Sequence: Synthetic oligonucleotide
gacucuggugacccacaguu

SEQ ID NO: 293 - RNA, 20 nt, Artificial Sequence
  Description of Artificial Sequence: Synthetic oligonucleotide
augacucuggugacccacag

SEQ ID NO: 294 - RNA, 20 nt, Artificial Sequence
  Description of Artificial Sequence: Synthetic oligonucleotide
uaugacucuggugacccaca

SEQ ID NO: 295 - RNA, 20 nt, Artificial Sequence
  Description of Artificial Sequence: Synthetic oligonucleotide
cuaugacucuggugacccac

SEQ ID NO: 296 - RNA, 20 nt, Artificial Sequence
  Description of Artificial Sequence: Synthetic oligonucleotide
ggcuaugacucuggugaccc

SEQ ID NO: 297 - RNA, 20 nt, Artificial Sequence
  Description of Artificial Sequence: Synthetic oligonucleotide
gggcuaugacucuggugacc

SEQ ID NO: 298 - RNA, 20 nt, Artificial Sequence
  Description of Artificial Sequence: Synthetic oligonucleotide
ugggcuaugacucuggugac

SEQ ID NO: 299 - RNA, 20 nt, Artificial Sequence
  Description of Artificial Sequence: Synthetic oligonucleotide
augggcuaugacucugguga

SEQ ID NO: 300 - RNA, 20 nt, Artificial Sequence
  Description of Artificial Sequence: Synthetic oligonucleotide
gcgccaguucaugggcuaug

SEQ ID NO: 301 - RNA, 20 nt, Artificial Sequence
  Description of Artificial Sequence: Synthetic oligonucleotide
gugcgccaguucaugggcua

SEQ ID NO: 302 - RNA, 20 nt, Artificial Sequence
  Description of Artificial Sequence: Synthetic oligonucleotide
uugccaaaccacuggugcgc

SEQ ID NO: 303 - RNA, 20 nt, Artificial Sequence
  Description of Artificial Sequence: Synthetic oligonucleotide
guugccaaaccacuggugcg

SEQ ID NO: 304 - RNA, 20 nt, Artificial Sequence
  Description of Artificial Sequence: Synthetic oligonucleotide
uugugaccagguugccaaac

SEQ ID NO: 305 - RNA, 20 nt, Artificial Sequence
  Description of Artificial Sequence: Synthetic oligonucleotide
auugugaccagguugccaaa

SEQ ID NO: 306 - RNA, 20 nt, Artificial Sequence
  Description of Artificial Sequence: Synthetic oligonucleotide
cauugugaccagguugccaa

SEQ ID NO: 307 - RNA, 20 nt, Artificial Sequence
  Description of Artificial Sequence: Synthetic oligonucleotide
uccauugugaccagguugcc

SEQ ID NO: 308 - RNA, 20 nt, Artificial Sequence
  Description of Artificial Sequence: Synthetic oligonucleotide
uuccauugugaccagguugc

SEQ ID NO: 309 - RNA, 20 nt, Artificial Sequence
  Description of Artificial Sequence: Synthetic oligonucleotide
auuccauugugaccagguug

SEQ ID NO: 310 - RNA, 20 nt, Artificial Sequence
  Description of Artificial Sequence: Synthetic oligonucleotide
ccauuccauugugaccaggu

SEQ ID NO: 311 - RNA, 20 nt, Artificial Sequence
  Description of Artificial Sequence: Synthetic oligonucleotide
accauuccauugugaccagg

SEQ ID NO: 312 - RNA, 20 nt, Artificial Sequence
  Description of Artificial Sequence: Synthetic oligonucleotide
caccauuccauugugaccag

SEQ ID NO: 313 - RNA, 20 nt, Artificial Sequence
  Description of Artificial Sequence: Synthetic oligonucleotide
ccaccauuccauugugacca

SEQ ID NO: 314 - RNA, 20 nt, Artificial Sequence
  Description of Artificial Sequence: Synthetic oligonucleotide
uccaccauuccauugugacc

SEQ ID NO: 315 - RNA, 20 nt, Artificial Sequence
  Description of Artificial Sequence: Synthetic oligonucleotide
uuccaccauuccauugugac

SEQ ID NO: 316 - RNA, 20 nt, Artificial Sequence
  Description of Artificial Sequence: Synthetic oligonucleotide
cagcgauaaguuccauguau

SEQ ID NO: 317 - RNA, 20 nt, Artificial Sequence
  Description of Artificial Sequence: Synthetic oligonucleotide
acagcgauaaguuccaugua

SEQ ID NO: 318 - RNA, 20 nt, Artificial Sequence
  Description of Artificial Sequence: Synthetic oligonucleotide
aacagcgauaaguuccaugu

SEQ ID NO: 319 - RNA, 20 nt, Artificial Sequence
  Description of Artificial Sequence: Synthetic oligonucleotide
uaacagcgauaaguuccaug

SEQ ID NO: 320 - RNA, 20 nt, Artificial Sequence
  Description of Artificial Sequence: Synthetic oligonucleotide
cauuaacagcgauaaguucc

SEQ ID NO: 321 - RNA, 20 nt, Artificial Sequence
  Description of Artificial Sequence: Synthetic oligonucleotide
gcauuaacagcgauaaguuc

SEQ ID NO: 322 - RNA, 20 nt, Artificial Sequence
  Description of Artificial Sequence: Synthetic oligonucleotide
guagcauuaacagcgauaag

SEQ ID NO: 323 - RNA, 20 nt, Artificial Sequence
  Description of Artificial Sequence: Synthetic oligonucleotide
gauauguagcauuaacagcg

SEQ ID NO: 324 - RNA, 20 nt, Artificial Sequence
  Description of Artificial Sequence: Synthetic oligonucleotide
gcucuggauauguagcauua

SEQ ID NO: 325 - RNA, 20 nt, Artificial Sequence
  Description of Artificial Sequence: Synthetic oligonucleotide
guuuccgcugguuuggagau

SEQ ID NO: 326 - RNA, 20 nt, Artificial Sequence
  Description of Artificial Sequence: Synthetic oligonucleotide
gguuuccgcugguuuggaga

SEQ ID NO: 327 - RNA, 20 nt, Artificial Sequence
  Description of Artificial Sequence: Synthetic oligonucleotide
ggguuuccgcugguuuggag

SEQ ID NO: 328 - RNA, 20 nt, Artificial Sequence
  Description of Artificial Sequence: Synthetic oligonucleotide
cauuuccuguauuugagucg

SEQ ID NO: 329 - RNA, 20 nt, Artificial Sequence
  Description of Artificial Sequence: Synthetic oligonucleotide
cccuuguuauaggaaacuuc

SEQ ID NO: 330 - RNA, 20 nt, Artificial Sequence
  Description of Artificial Sequence: Synthetic oligonucleotide
cucccuuguuauaggaaacu

SEQ ID NO: 331 - RNA, 20 nt, Artificial Sequence
  Description of Artificial Sequence: Synthetic oligonucleotide
gcucccuuguuauaggaaac

SEQ ID NO: 332 - RNA, 20 nt, Artificial Sequence
  Description of Artificial Sequence: Synthetic oligonucleotide
agcucccuuguuauaggaaa

SEQ ID NO: 333 - RNA, 20 nt, Artificial Sequence
  Description of Artificial Sequence: Synthetic oligonucleotide
aagcucccuuguuauaggaa

SEQ ID NO: 334 - RNA, 20 nt, Artificial Sequence
  Description of Artificial Sequence: Synthetic oligonucleotide
cccagaaaauccuugagcau

SEQ ID NO: 335 - RNA, 20 nt, Artificial Sequence
  Description of Artificial Sequence: Synthetic oligonucleotide
cucacccagaaaauccuuga

SEQ ID NO: 336 - RNA, 20 nt, Artificial Sequence
  Description of Artificial Sequence: Synthetic oligonucleotide
cuccucacccagaaaauccu

SEQ ID NO: 337 - RNA, 20 nt, Artificial Sequence
  Description of Artificial Sequence: Synthetic oligonucleotide
ucuccucacccagaaaaucc

SEQ ID NO: 338 - RNA, 20 nt, Artificial Sequence
  Description of Artificial Sequence: Synthetic oligonucleotide
ccacaagucaucauucuuag

SEQ ID NO: 339 - RNA, 20 nt, Artificial Sequence
  Description of Artificial Sequence: Synthetic oligonucleotide
cugcuccacaagucaucauu

SEQ ID NO: 340 - RNA, 20 nt, Artificial Sequence
  Description of Artificial Sequence: Synthetic oligonucleotide
acugcuccacaagucaucau

SEQ ID NO: 341 - RNA, 20 nt, Artificial Sequence
  Description of Artificial Sequence: Synthetic oligonucleotide
ugacagacugcuccacaagu

SEQ ID NO: 342 - RNA, 20 nt, Artificial Sequence
  Description of Artificial Sequence: Synthetic oligonucleotide
uugacagacugcuccacaag

SEQ ID NO: 343 - RNA, 20 nt, Artificial Sequence
  Description of Artificial Sequence: Synthetic oligonucleotide
auuugacagacugcuccaca

SEQ ID NO: 344 - RNA, 20 nt, Artificial Sequence
  Description of Artificial Sequence: Synthetic oligonucleotide
uauuugacagacugcuccac

SEQ ID NO: 345 - RNA, 20 nt, Artificial Sequence
  Description of Artificial Sequence: Synthetic oligonucleotide
cuauuugacagacugcucca

SEQ ID NO: 346 - RNA, 20 nt, Artificial Sequence
  Description of Artificial Sequence: Synthetic oligonucleotide
acuauuugacagacugcucc

SEQ ID NO: 347 - RNA, 20 nt, Artificial Sequence
  Description of Artificial Sequence: Synthetic oligonucleotide
aacuauuugacagacugcuc

SEQ ID NO: 348 - RNA, 20 nt, Artificial Sequence
  Description of Artificial Sequence: Synthetic oligonucleotide
caacuauuugacagacugcu

SEQ ID NO: 349 - RNA, 20 nt, Artificial Sequence
  Description of Artificial Sequence: Synthetic oligonucleotide
acaacuauuugacagacugc

SEQ ID NO: 350 - RNA, 20 nt, Artificial Sequence
  Description of Artificial Sequence: Synthetic oligonucleotide
ccaccagauguaaaaucacu

SEQ ID NO: 351 - RNA, 20 nt, Artificial Sequence
  Description of Artificial Sequence: Synthetic oligonucleotide
uccaccagauguaaaaucac

SEQ ID NO: 352 - RNA, 20 nt, Artificial Sequence
  Description of Artificial Sequence: Synthetic oligonucleotide
gacaaacuccaccagaugua

SEQ ID NO: 353 - RNA, 20 nt, Artificial Sequence
  Description of Artificial Sequence: Synthetic oligonucleotide
cgaaugacaaacuccaccag

SEQ ID NO: 354 - RNA, 20 nt, Artificial Sequence
  Description of Artificial Sequence: Synthetic oligonucleotide
ccgaaugacaaacuccacca

SEQ ID NO: 355 - RNA, 20 nt, Artificial Sequence
  Description of Artificial Sequence: Synthetic oligonucleotide
gauccgaaugacaaacucca

SEQ ID NO: 356 - RNA, 20 nt, Artificial Sequence
  Description of Artificial Sequence: Synthetic oligonucleotide
auguuacuugucaucuuggg

SEQ ID NO: 357 - RNA, 20 nt, Artificial Sequence
  Description of Artificial Sequence: Synthetic oligonucleotide
gcauguuacuugucaucuug

SEQ ID NO: 358 - RNA, 20 nt, Artificial Sequence
  Description of Artificial Sequence: Synthetic oligonucleotide
gagcauguuacuugucaucu

SEQ ID NO: 359 - RNA, 20 nt, Artificial Sequence
  Description of Artificial Sequence: Synthetic oligonucleotide
cgagcauguuacuugucauc

SEQ ID NO: 360 - RNA, 20 nt, Artificial Sequence
  Description of Artificial Sequence: Synthetic oligonucleotide
gcgagcauguuacuugucau

SEQ ID NO: 361 - RNA, 20 nt, Artificial Sequence
  Description of Artificial Sequence: Synthetic oligonucleotide
ggcgagcauguuacuuguca

SEQ ID NO: 362 - RNA, 20 nt, Artificial Sequence
  Description of Artificial Sequence: Synthetic oligonucleotide
aggcgagcauguuacuuguc

SEQ ID NO: 363 - RNA, 20 nt, Artificial Sequence
  Description of Artificial Sequence: Synthetic oligonucleotide
aaggcgagcauguuacuugu

SEQ ID NO: 364 - RNA, 20 nt, Artificial Sequence
  Description of Artificial Sequence: Synthetic oligonucleotide
aaaggcgagcauguuacuug

SEQ ID NO: 365 - RNA, 20 nt, Artificial Sequence
  Description of Artificial Sequence: Synthetic oligonucleotide
gaaaggcgagcauguuacuu

SEQ ID NO: 366 - RNA, 20 nt, Artificial Sequence
  Description of Artificial Sequence: Synthetic oligonucleotide
agaaaggcgagcauguuacu

SEQ ID NO: 367 - RNA, 20 nt, Artificial Sequence
  Description of Artificial Sequence: Synthetic oligonucleotide
cagaaaggcgagcauguuac

SEQ ID NO: 368 - RNA, 20 nt, Artificial Sequence
  Description of Artificial Sequence: Synthetic oligonucleotide
ccagaaaggcgagcauguua

SEQ ID NO: 369 - RNA, 20 nt, Artificial Sequence
  Description of Artificial Sequence: Synthetic oligonucleotide
cccagaaaggcgagcauguu

SEQ ID NO: 370 - RNA, 20 nt, Artificial Sequence
  Description of Artificial Sequence: Synthetic oligonucleotide
ucuuugaccucugcauuuuc

SEQ ID NO: 371 - RNA, 20 nt, Artificial Sequence
  Description of Artificial Sequence: Synthetic oligonucleotide
aucaucucuuugaccucugc

SEQ ID NO: 372 - RNA, 20 nt, Artificial Sequence
  Description of Artificial Sequence: Synthetic oligonucleotide
ccauguagucaucaucucuu

SEQ ID NO: 373 - RNA, 20 nt, Artificial Sequence
  Description of Artificial Sequence: Synthetic oligonucleotide
agaguccauguagucaucau

SEQ ID NO: 374 - RNA, 20 nt, Artificial Sequence
  Description of Artificial Sequence: Synthetic oligonucleotide
gagaguccauguagucauca

SEQ ID NO: 375 - RNA, 20 nt, Artificial Sequence
  Description of Artificial Sequence: Synthetic oligonucleotide
ggagaguccauguagucauc

SEQ ID NO: 376 - RNA, 20 nt, Artificial Sequence
  Description of Artificial Sequence: Synthetic oligonucleotide
gauuccuuucuggagagucc

SEQ ID NO: 377 - RNA, 20 nt, Artificial Sequence
  Description of Artificial Sequence: Synthetic oligonucleotide
uuguuuaaccaccagcaggg

SEQ ID NO: 378 - RNA, 20 nt, Artificial Sequence
  Description of Artificial Sequence: Synthetic oligonucleotide
cuuguuuaaccaccagcagg

SEQ ID NO: 379 - RNA, 20 nt, Artificial Sequence
  Description of Artificial Sequence: Synthetic oligonucleotide
ucuuguuuaaccaccagcag

SEQ ID NO: 380 - RNA, 20 nt, Artificial Sequence
  Description of Artificial Sequence: Synthetic oligonucleotide
cgucuuguuuaaccaccagc

SEQ ID NO: 381 - RNA, 20 nt, Artificial Sequence
  Description of Artificial Sequence: Synthetic oligonucleotide
ccgucuuguuuaaccaccag

SEQ ID NO: 382 - RNA, 20 nt, Artificial Sequence
  Description of Artificial Sequence: Synthetic oligonucleotide
cccgucuuguuuaaccacca

SEQ ID NO: 383 - RNA, 20 nt, Artificial Sequence
  Description of Artificial Sequence: Synthetic oligonucleotide
acccgucuuguuuaaccacc

SEQ ID NO: 384 - RNA, 20 nt, Artificial Sequence
  Description of Artificial Sequence: Synthetic oligonucleotide
cacccgucuuguuuaaccac

SEQ ID NO: 385 - RNA, 20 nt, Artificial Sequence
  Description of Artificial Sequence: Synthetic oligonucleotide
acacccgucuuguuuaacca

SEQ ID NO: 386 - RNA, 20 nt, Artificial Sequence
  Description of Artificial Sequence: Synthetic oligonucleotide
ggagugaacacccgucuugu

SEQ ID NO: 387 - RNA, 20 nt, Artificial Sequence
  Description of Artificial Sequence: Synthetic oligonucleotide
cggagugaacacccgucuug

SEQ ID NO: 388 - RNA, 20 nt, Artificial Sequence
  Description of Artificial Sequence: Synthetic oligonucleotide
ucggagugaacacccgucuu

SEQ ID NO: 389 - RNA, 20 nt, Artificial Sequence
  Description of Artificial Sequence: Synthetic oligonucleotide
gucggagugaacacccgucu

SEQ ID NO: 390 - RNA, 20 nt, Artificial Sequence
  Description of Artificial Sequence: Synthetic oligonucleotide
agucggagugaacacccguc

SEQ ID NO: 391 - RNA, 20 nt, Artificial Sequence
  Description of Artificial Sequence: Synthetic oligonucleotide
cagucggagugaacacccgu

SEQ ID NO: 392 - RNA, 20 nt, Artificial Sequence
  Description of Artificial Sequence: Synthetic oligonucleotide
ugcagucggagugaacaccc

SEQ ID NO: 393 - RNA, 20 nt, Artificial Sequence
  Description of Artificial Sequence: Synthetic oligonucleotide
uugcagucggagugaacacc

SEQ ID NO: 394 - RNA, 20 nt, Artificial Sequence
  Description of Artificial Sequence: Synthetic oligonucleotide
guugcagucggagugaacac

SEQ ID NO: 395 - RNA, 20 nt, Artificial Sequence
  Description of Artificial Sequence: Synthetic oligonucleotide
ccuccauucagggucuuccu

SEQ ID NO: 396 - RNA, 20 nt, Artificial Sequence
  Description of Artificial Sequence: Synthetic oligonucleotide
augggauaugccacagguac

SEQ ID NO: 397 - RNA, 20 nt, Artificial Sequence
  Description of Artificial Sequence: Synthetic oligonucleotide
aaugggauaugccacaggua

SEQ ID NO: 398 - RNA, 20 nt, Artificial Sequence
  Description of Artificial Sequence: Synthetic oligonucleotide
caaugggauaugccacaggu

SEQ ID NO: 399 - RNA, 20 nt, Artificial Sequence
  Description of Artificial Sequence: Synthetic oligonucleotide
ucaaugggauaugccacagg

SEQ ID NO: 400 - RNA, 20 nt, Artificial Sequence
  Description of Artificial Sequence: Synthetic oligonucleotide
guaggucaaugggauaugcc

SEQ ID NO: 401 - RNA, 20 nt, Artificial Sequence
  Description of Artificial Sequence: Synthetic oligonucleotide
aguaggucaaugggauaugc

SEQ ID NO: 402 - RNA, 20 nt, Artificial Sequence
  Description of Artificial Sequence: Synthetic oligonucleotide
gaguaggucaaugggauaug

SEQ ID NO: 403 - RNA, 20 nt, Artificial Sequence
  Description of Artificial Sequence: Synthetic oligonucleotide
ggaguaggucaaugggauau

SEQ ID NO: 404 - RNA, 20 nt, Artificial Sequence
  Description of Artificial Sequence: Synthetic oligonucleotide
uggaguaggucaaugggaua

SEQ ID NO: 405 - RNA, 20 nt, Artificial Sequence
  Description of Artificial Sequence: Synthetic oligonucleotide
cguggaguaggucaauggga

SEQ ID NO: 406 - RNA, 20 nt, Artificial Sequence
  Description of Artificial Sequence: Synthetic oligonucleotide
ucguggaguaggucaauggg

SEQ ID NO: 407 - RNA, 20 nt, Artificial Sequence
  Description of Artificial Sequence: Synthetic oligonucleotide
cucguggaguaggucaaugg

SEQ ID NO: 408 - RNA, 20 nt, Artificial Sequence
  Description of Artificial Sequence: Synthetic oligonucleotide
cauuagaagaacucguggag

SEQ ID NO: 409 - RNA, 20 nt, Artificial Sequence
  Description of Artificial Sequence: Synthetic oligonucleotide
acauuagaagaacucgugga

SEQ ID NO: 410 - RNA, 20 nt, Artificial Sequence
  Description of Artificial Sequence: Synthetic oligonucleotide
ucacauuagaagaacucgug

SEQ ID NO: 411 - RNA, 20 nt, Artificial Sequence
  Description of Artificial Sequence: Synthetic oligonucleotide
gaucacauuagaagaacucg

SEQ ID NO: 412 - RNA, 20 nt, Artificial Sequence
  Description of Artificial Sequence: Synthetic oligonucleotide
ggaucacauuagaagaacuc

SEQ ID NO: 413 - RNA, 20 nt, Artificial Sequence
  Description of Artificial Sequence: Synthetic oligonucleotide
guggaucacauuagaagaac

SEQ ID NO: 414 - RNA, 20 nt, Artificial Sequence
  Description of Artificial Sequence: Synthetic oligonucleotide
agaaugugucuguggaucac

SEQ ID NO: 415 - RNA, 20 nt, Artificial Sequence
  Description of Artificial Sequence: Synthetic oligonucleotide
uagaaugugucuguggauca

SEQ ID NO: 416 - RNA, 20 nt, Artificial Sequence
  Description of Artificial Sequence: Synthetic oligonucleotide
uuucagguagauccagagua

SEQ ID NO: 417 - RNA, 20 nt, Artificial Sequence
  Description of Artificial Sequence: Synthetic oligonucleotide
uuuucagguagauccagagu

SEQ ID NO: 418 - RNA, 20 nt, Artificial Sequence
  Description of Artificial Sequence: Synthetic oligonucleotide
ucuuuucagguagauccaga

SEQ ID NO: 419 - RNA, 20 nt, Artificial Sequence
  Description of Artificial Sequence: Synthetic oligonucleotide
gucuuuucagguagauccag

SEQ ID NO: 420 - RNA, 20 nt, Artificial Sequence
  Description of Artificial Sequence: Synthetic oligonucleotide
ggucuuuucagguagaucca

SEQ ID NO: 421 - RNA, 20 nt, Artificial Sequence
  Description of Artificial Sequence: Synthetic oligonucleotide
cuggucuuuucagguagauc

SEQ ID NO: 422 - RNA, 20 nt, Artificial Sequence
  Description of Artificial Sequence: Synthetic oligonucleotide
ccaacuggucuuuucaggua

SEQ ID NO: 423 - RNA, 20 nt, Artificial Sequence
  Description of Artificial Sequence: Synthetic oligonucleotide
cccaacuggucuuuucaggu

SEQ ID NO: 424 - RNA, 20 nt, Artificial Sequence
  Description of Artificial Sequence: Synthetic oligonucleotide
acccaacuggucuuuucagg

SEQ ID NO: 425 - RNA, 20 nt, Artificial Sequence
  Description of Artificial Sequence: Synthetic oligonucleotide
cacccaacuggucuuuucag

SEQ ID NO: 426 - RNA, 20 nt, Artificial Sequence
  Description of Artificial Sequence: Synthetic oligonucleotide
uucacccaacuggucuuuuc

SEQ ID NO: 427 - RNA, 20 nt, Artificial Sequence
  Description of Artificial Sequence: Synthetic oligonucleotide
uuucacccaacuggucuuuu

SEQ ID NO: 428 - RNA, 20 nt, Artificial Sequence
  Description of Artificial Sequence: Synthetic oligonucleotide
auuucacccaacuggucuuu

SEQ ID NO: 429 - RNA, 20 nt, Artificial Sequence
  Description of Artificial Sequence: Synthetic oligonucleotide
aauuucacccaacuggucuu

SEQ ID NO: 430 - RNA, 20 nt, Artificial Sequence
  Description of Artificial Sequence: Synthetic oligonucleotide
guaaccauuugaguccacau

SEQ ID NO: 431 - RNA, 20 nt, Artificial Sequence
  Description of Artificial Sequence: Synthetic oligonucleotide
aguaaccauuugaguccaca

SEQ ID NO: 432 - RNA, 20 nt, Artificial Sequence
  Description of Artificial Sequence: Synthetic oligonucleotide
guaguaaccauuugagucca

SEQ ID NO: 433 - RNA, 20 nt, Artificial Sequence
  Description of Artificial Sequence: Synthetic oligonucleotide
uguaguaaccauuugagucc

SEQ ID NO: 434 - RNA, 20 nt, Artificial Sequence
  Description of Artificial Sequence: Synthetic oligonucleotide
cgauguaguaaccauuugag

SEQ ID NO: 435 - RNA, 20 nt, Artificial Sequence
  Description of Artificial Sequence: Synthetic oligonucleotide
agugaacgauguaguaacca

SEQ ID NO: 436 - RNA, 20 nt, Artificial Sequence
  Description of Artificial Sequence: Synthetic oligonucleotide
uagugaacgauguaguaacc

SEQ ID NO: 437 - RNA, 20 nt, Artificial Sequence
  Description of Artificial Sequence: Synthetic oligonucleotide
cucauagugaacgauguagu

SEQ ID NO: 438 - RNA, 20 nt, Artificial Sequence
  Description of Artificial Sequence: Synthetic oligonucleotide
ccucauagugaacgauguag

SEQ ID NO: 439 - RNA, 20 nt, Artificial Sequence
  Description of Artificial Sequence: Synthetic oligonucleotide
cccucauagugaacgaugua

SEQ ID NO: 440 - RNA, 20 nt, Artificial Sequence
  Description of Artificial Sequence: Synthetic oligonucleotide
acccucauagugaacgaugu

SEQ ID NO: 441 - RNA, 20 nt, Artificial Sequence
  Description of Artificial Sequence: Synthetic oligonucleotide
gacccucauagugaacgaug

SEQ ID NO: 442 - RNA, 20 nt, Artificial Sequence
  Description of Artificial Sequence: Synthetic oligonucleotide
ugacccucauagugaacgau

SEQ ID NO: 443 - RNA, 20 nt, Artificial Sequence
  Description of Artificial Sequence: Synthetic oligonucleotide
gaguuggucccauccaugac

SEQ ID NO: 444 - RNA, 20 nt, Artificial Sequence
  Description of Artificial Sequence: Synthetic oligonucleotide
augaguuggucccauccaug

SEQ ID NO: 445 - RNA, 20 nt, Artificial Sequence
  Description of Artificial Sequence: Synthetic oligonucleotide
aaugaguuggucccauccau

SEQ ID NO: 446 - RNA, 20 nt, Artificial Sequence
  Description of Artificial Sequence: Synthetic oligonucleotide
uaaugaguuggucccaucca

SEQ ID NO: 447 - RNA, 20 nt, Artificial Sequence
  Description of Artificial Sequence: Synthetic oligonucleotide
guaaugaguuggucccaucc

SEQ ID NO: 448 - RNA, 20 nt, Artificial Sequence
  Description of Artificial Sequence: Synthetic oligonucleotide
uguaaugaguuggucccauc

SEQ ID NO: 449 - RNA, 20 nt, Artificial Sequence
  Description of Artificial Sequence: Synthetic oligonucleotide
guguaaugaguuggucccau

SEQ ID NO: 450 - RNA, 20 nt, Artificial Sequence
  Description of Artificial Sequence: Synthetic oligonucleotide
uguguaaugaguugguccca

SEQ ID NO: 451 - RNA, 20 nt, Artificial Sequence
  Description of Artificial Sequence: Synthetic oligonucleotide
cuguguaaugaguugguccc

SEQ ID NO: 452 - RNA, 20 nt, Artificial Sequence
  Description of Artificial Sequence: Synthetic oligonucleotide
gcuguguaaugaguuggucc

SEQ ID NO: 453 - RNA, 20 nt, Artificial Sequence
  Description of Artificial Sequence: Synthetic oligonucleotide
agcuguguaaugaguugguc

SEQ ID NO: 454 - RNA, 20 nt, Artificial Sequence
  Description of Artificial Sequence: Synthetic oligonucleotide
gugugugguucugauucagc

SEQ ID NO: 455 - RNA, 20 nt, Artificial Sequence
  Description of Artificial Sequence: Synthetic oligonucleotide
aagugugugguucugauuca

SEQ ID NO: 456 - RNA, 20 nt, Artificial Sequence
  Description of Artificial Sequence: Synthetic oligonucleotide
cuuaggucugagaagugugu

SEQ ID NO: 457 - RNA, 20 nt, Artificial Sequence
  Description of Artificial Sequence: Synthetic oligonucleotide
ccuuaggucugagaagugug

SEQ ID NO: 458 - RNA, 20 nt, Artificial Sequence
  Description of Artificial Sequence: Synthetic oligonucleotide
uccuuaggucugagaagugu

SEQ ID NO: 459 - RNA, 20 nt, Artificial Sequence
  Description of Artificial Sequence: Synthetic oligonucleotide
guccuuaggucugagaagug

SEQ ID NO: 460 - RNA, 20 nt, Artificial Sequence
  Description of Artificial Sequence: Synthetic oligonucleotide
uguccuuaggucugagaagu

SEQ ID NO: 461 - RNA, 20 nt, Artificial Sequence
  Description of Artificial Sequence: Synthetic oligonucleotide
acucuguccuuaggucugag

SEQ ID NO: 462 - RNA, 20 nt, Artificial Sequence
  Description of Artificial Sequence: Synthetic oligonucleotide
uacucuguccuuaggucuga

SEQ ID NO: 463 - RNA, 20 nt, Artificial Sequence
  Description of Artificial Sequence: Synthetic oligonucleotide
cuacucuguccuuaggucug

SEQ ID NO: 464 - RNA, 20 nt, Artificial Sequence
  Description of Artificial Sequence: Synthetic oligonucleotide
ucagucucccugcaccaacu

SEQ ID NO: 465 - RNA, 20 nt, Artificial Sequence
  Description of Artificial Sequence: Synthetic oligonucleotide
gucagucucccugcaccaac

SEQ ID NO: 466 - RNA, 20 nt, Artificial Sequence
  Description of Artificial Sequence: Synthetic oligonucleotide
ggucagucucccugcaccaa

SEQ ID NO: 467 - RNA, 20 nt, Artificial Sequence
  Description of Artificial Sequence: Synthetic oligonucleotide
uugucuagggucagucuccc

SEQ ID NO: 468 - RNA, 20 nt, Artificial Sequence
  Description of Artificial Sequence: Synthetic oligonucleotide
uuugucuagggucagucucc

SEQ ID NO: 469 - RNA, 20 nt, Artificial Sequence
  Description of Artificial Sequence: Synthetic oligonucleotide
cuuugucuagggucagucuc

SEQ ID NO: 470 - RNA, 20 nt, Artificial Sequence
  Description of Artificial Sequence: Synthetic oligonucleotide
gcuuugucuagggucagucu

SEQ ID NO: 471 - RNA, 20 nt, Artificial Sequence
  Description of Artificial Sequence: Synthetic oligonucleotide
agcuuugucuagggucaguc

SEQ ID NO: 472 - RNA, 20 nt, Artificial Sequence
  Description of Artificial Sequence: Synthetic oligonucleotide
gagcuuugucuagggucagu

SEQ ID NO: 473 - RNA, 20 nt, Artificial Sequence
  Description of Artificial Sequence: Synthetic oligonucleotide
aagagcuuugucuaggguca

SEQ ID NO: 474 - RNA, 20 nt, Artificial Sequence
  Description of Artificial Sequence: Synthetic oligonucleotide
caagagcuuugucuaggguc

SEQ ID NO: 475 - RNA, 20 nt, Artificial Sequence
  Description of Artificial Sequence: Synthetic oligonucleotide
ucaagagcuuugucuagggu

SEQ ID NO: 476 - RNA, 20 nt, Artificial Sequence
  Description of Artificial Sequence: Synthetic oligonucleotide
ugucaagagcuuugucuagg

SEQ ID NO: 477 - RNA, 20 nt, Artificial Sequence
  Description of Artificial Sequence: Synthetic oligonucleotide
augucaagagcuuugucuag

SEQ ID NO: 478 - RNA, 20 nt, Artificial Sequence
  Description of Artificial Sequence: Synthetic oligonucleotide
caugucaagagcuuugucua

SEQ ID NO: 479 - RNA, 20 nt, Artificial Sequence
  Description of Artificial Sequence: Synthetic oligonucleotide
gucaugucaagagcuuuguc

SEQ ID NO: 480 - RNA, 20 nt, Artificial Sequence
  Description of Artificial Sequence: Synthetic oligonucleotide
aagucaugucaagagcuuug

SEQ ID NO: 481 - RNA, 20 nt, Artificial Sequence
  Description of Artificial Sequence: Synthetic oligonucleotide
guaagucaugucaagagcuu

SEQ ID NO: 482 - RNA, 20 nt, Artificial Sequence
  Description of Artificial Sequence: Synthetic oligonucleotide
aguaagucaugucaagagcu

SEQ ID NO: 483 - RNA, 20 nt, Artificial Sequence
  Description of Artificial Sequence: Synthetic oligonucleotide
uaguaagucaugucaagagc

SEQ ID NO: 484 - RNA, 20 nt, Artificial Sequence
  Description of Artificial Sequence: Synthetic oligonucleotide
guaguaagucaugucaagag

SEQ ID NO: 485 - RNA, 20 nt, Artificial Sequence
  Description of Artificial Sequence: Synthetic oligonucleotide
gguaguaagucaugucaaga

SEQ ID NO: 486 - RNA, 20 nt, Artificial Sequence
  Description of Artificial Sequence: Synthetic oligonucleotide
agguaguaagucaugucaag

SEQ ID NO: 487 - RNA, 20 nt, Artificial Sequence
  Description of Artificial Sequence: Synthetic oligonucleotide
ggagguaguaagucauguca

SEQ ID NO: 488 - RNA, 20 nt, Artificial Sequence
  Description of Artificial Sequence: Synthetic oligonucleotide
uggagguaguaagucauguc

SEQ ID NO: 489 - RNA, 20 nt, Artificial Sequence
  Description of Artificial Sequence: Synthetic oligonucleotide
uuggagguaguaagucaugu

SEQ ID NO: 490 - RNA, 20 nt, Artificial Sequence
  Description of Artificial Sequence: Synthetic oligonucleotide
guuggagguaguaagucaug

SEQ ID NO: 491 - RNA, 20 nt, Artificial Sequence
  Description of Artificial Sequence: Synthetic oligonucleotide
uguuggagguaguaagucau

SEQ ID NO: 492 - RNA, 20 nt, Artificial Sequence
  Description of Artificial Sequence: Synthetic oligonucleotide
agaccuucgagaagugcggg

SEQ ID NO: 493 - RNA, 20 nt, Artificial Sequence
  Description of Artificial Sequence: Synthetic oligonucleotide
cagaccuucgagaagugcgg

SEQ ID NO: 494 - RNA, 20 nt, Artificial Sequence
  Description of Artificial Sequence: Synthetic oligonucleotide
acucagaccuucgagaagug

SEQ ID NO: 495 - RNA, 20 nt, Artificial Sequence
  Description of Artificial Sequence: Synthetic oligonucleotide
aacucagaccuucgagaagu

SEQ ID NO: 496 - RNA, 20 nt, Artificial Sequence
  Description of Artificial Sequence: Synthetic oligonucleotide
uaacucagaccuucgagaag

SEQ ID NO: 497 - RNA, 20 nt, Artificial Sequence
  Description of Artificial Sequence: Synthetic oligonucleotide
guaacucagaccuucgagaa

SEQ ID NO: 498 - RNA, 20 nt, Artificial Sequence
  Description of Artificial Sequence: Synthetic oligonucleotide
aguaacucagaccuucgaga

SEQ ID NO: 499 - RNA, 20 nt, Artificial Sequence
  Description of Artificial Sequence: Synthetic oligonucleotide
uccaaguaacucagaccuuc

SEQ ID NO: 500 - RNA, 20 nt, Artificial Sequence
  Description of Artificial Sequence: Synthetic oligonucleotide
uuccaaguaacucagaccuu

SEQ ID NO: 501 - RNA, 20 nt, Artificial Sequence
  Description of Artificial Sequence: Synthetic oligonucleotide
gauuccaaguaacucagacc

SEQ ID NO: 502 - RNA, 20 nt, Artificial Sequence
  Description of Artificial Sequence: Synthetic oligonucleotide
cgauuccaaguaacucagac

SEQ ID NO: 503 - RNA, 20 nt, Artificial Sequence
  Description of Artificial Sequence: Synthetic oligonucleotide
gugguaaaacgauuccaagu

SEQ ID NO: 504 - RNA, 20 nt, Artificial Sequence
  Description of Artificial Sequence: Synthetic oligonucleotide
ugugguaaaacgauuccaag

SEQ ID NO: 505 - RNA, 20 nt, Artificial Sequence
  Description of Artificial Sequence: Synthetic oligonucleotide
caugugguaaaacgauucca

SEQ ID NO: 506 - RNA, 20 nt, Artificial Sequence
  Description of Artificial Sequence: Synthetic oligonucleotide
ucaugugguaaaacgauucc

SEQ ID NO: 507 - RNA, 20 nt, Artificial Sequence
  Description of Artificial Sequence: Synthetic oligonucleotide
ccaucaugugguaaaacgau

SEQ ID NO: 508 - RNA, 20 nt, Artificial Sequence
  Description of Artificial Sequence: Synthetic oligonucleotide
cuguccaucaugugguaaaa

SEQ ID NO: 509 - RNA, 20 nt, Artificial Sequence
  Description of Artificial Sequence: Synthetic oligonucleotide
ucuguccaucaugugguaaa

SEQ ID NO: 510 - RNA, 20 nt, Artificial Sequence
  Description of Artificial Sequence: Synthetic oligonucleotide
uucuguccaucaugugguaa

SEQ ID NO: 511 - RNA, 20 nt, Artificial Sequence
  Description of Artificial Sequence: Synthetic oligonucleotide
ccuucuguccaucauguggu

SEQ ID NO: 512 - RNA, 20 nt, Artificial Sequence
  Description of Artificial Sequence: Synthetic oligonucleotide
cgcuugagguuuucagagau

SEQ ID NO: 513 - RNA, 20 nt, Artificial Sequence
  Description of Artificial Sequence: Synthetic oligonucleotide
aacgcuugagguuuucagag

SEQ ID NO: 514 - RNA, 20 nt, Artificial Sequence
  Description of Artificial Sequence: Synthetic oligonucleotide
uaacgcuugagguuuucaga

SEQ ID NO: 515 - RNA, 20 nt, Artificial Sequence
  Description of Artificial Sequence: Synthetic oligonucleotide
guaacgcuugagguuuucag

SEQ ID NO: 516 - RNA, 20 nt, Artificial Sequence
  Description of Artificial Sequence: Synthetic oligonucleotide
gguaacgcuugagguuuuca

SEQ ID NO: 517 - RNA, 20 nt, Artificial Sequence
  Description of Artificial Sequence: Synthetic oligonucleotide
agguaacgcuugagguuuuc

SEQ ID NO: 518 - RNA, 20 nt, Artificial Sequence
  Description of Artificial Sequence: Synthetic oligonucleotide
aagguaacgcuugagguuuu

SEQ ID NO: 519 - RNA, 20 nt, Artificial Sequence
  Description of Artificial Sequence: Synthetic oligonucleotide
gaagguaacgcuugagguuu

SEQ ID NO: 520 - RNA, 20 nt, Artificial Sequence
  Description of Artificial Sequence: Synthetic oligonucleotide
agaagguaacgcuugagguu

SEQ ID NO: 521 - RNA, 20 nt, Artificial Sequence
  Description of Artificial Sequence: Synthetic oligonucleotide
aagaagguaacgcuugaggu

SEQ ID NO: 522 - RNA, 20 nt, Artificial Sequence
  Description of Artificial Sequence: Synthetic oligonucleotide
gaagaagguaacgcuugagg

SEQ ID NO: 523 - RNA, 20 nt, Artificial Sequence
  Description of Artificial Sequence: Synthetic oligonucleotide
ugaagaagguaacgcuugag

SEQ ID NO: 524 - RNA, 20 nt, Artificial Sequence
  Description of Artificial Sequence: Synthetic oligonucleotide
cugaagaagguaacgcuuga

SEQ ID NO: 525 - RNA, 20 nt, Artificial Sequence
  Description of Artificial Sequence: Synthetic oligonucleotide
acugaagaagguaacgcuug

SEQ ID NO: 526 - RNA, 20 nt, Artificial Sequence
  Description of Artificial Sequence: Synthetic oligonucleotide
uacugaagaagguaacgcuu

SEQ ID NO: 527 - RNA, 20 nt, Artificial Sequence
  Description of Artificial Sequence: Synthetic oligonucleotide
cugucaaucacuggcuuaaa

SEQ ID NO: 528 - RNA, 20 nt, Artificial Sequence
  Description of Artificial Sequence: Synthetic oligonucleotide
ccugucaaucacuggcuuaa

SEQ ID NO: 529 - RNA, 20 nt, Artificial Sequence
  Description of Artificial Sequence: Synthetic oligonucleotide
gccugucaaucacuggcuua

SEQ ID NO: 530 - RNA, 20 nt, Artificial Sequence
  Description of Artificial Sequence: Synthetic oligonucleotide
ugccugucaaucacuggcuu

SEQ ID NO: 531 - RNA, 20 nt, Artificial Sequence
  Description of Artificial Sequence: Synthetic oligonucleotide
uugccugucaaucacuggcu

SEQ ID NO: 532 - RNA, 20 nt, Artificial Sequence
  Description of Artificial Sequence: Synthetic oligonucleotide
uuugccugucaaucacuggc

SEQ ID NO: 533 - RNA, 20 nt, Artificial Sequence
  Description of Artificial Sequence: Synthetic oligonucleotide
gcuuugccugucaaucacug

SEQ ID NO: 534 - RNA, 20 nt, Artificial Sequence
  Description of Artificial Sequence: Synthetic oligonucleotide
agcuuugccugucaaucacu

SEQ ID NO: 535 - RNA, 20 nt, Artificial Sequence
  Description of Artificial Sequence: Synthetic oligonucleotide
cagcuuugccugucaaucac

SEQ ID NO: 536 - RNA, 20 nt, Artificial Sequence
  Description of Artificial Sequence: Synthetic oligonucleotide
ccagcuuugccugucaauca

SEQ ID NO: 537 - RNA, 20 nt, Artificial Sequence
  Description of Artificial Sequence: Synthetic oligonucleotide
uccagcuuugccugucaauc

SEQ ID NO: 538 - RNA, 20 nt, Artificial Sequence
  Description of Artificial Sequence: Synthetic oligonucleotide
cuccagcuuugccugucaau

SEQ ID NO: 539 - RNA, 20 nt, Artificial Sequence
  Description of Artificial Sequence: Synthetic oligonucleotide
cacuccagcuuugccuguca

SEQ ID NO: 540 - RNA, 20 nt, Artificial Sequence
  Description of Artificial Sequence: Synthetic oligonucleotide
ucacuccagcuuugccuguc

SEQ ID NO: 541 - RNA, 20 nt, Artificial Sequence
  Description of Artificial Sequence: Synthetic oligonucleotide
uugucacuccagcuuugccu

SEQ ID NO: 542 - RNA, 20 nt, Artificial Sequence
  Description of Artificial Sequence: Synthetic oligonucleotide
cuugucacuccagcuuugcc

SEQ ID NO: 543 - RNA, 20 nt, Artificial Sequence
  Description of Artificial Sequence: Synthetic oligonucleotide
agcauccugucccagacuga

SEQ ID NO: 544 - RNA, 20 nt, Artificial Sequence
  Description of Artificial Sequence: Synthetic oligonucleotide
ucacaggccagcuucaagag

SEQ ID NO: 545 - RNA, 20 nt, Artificial Sequence
  Description of Artificial Sequence: Synthetic oligonucleotide
ggucacaggccagcuucaag

SEQ ID NO: 546 - RNA, 20 nt, Artificial Sequence
  Description of Artificial Sequence: Synthetic oligonucleotide
aggucacaggccagcuucaa

SEQ ID NO: 547 - RNA, 20 nt, Artificial Sequence
  Description of Artificial Sequence: Synthetic oligonucleotide
ucaggucacaggccagcuuc

SEQ ID NO: 548 - RNA, 20 nt, Artificial Sequence
  Description of Artificial Sequence: Synthetic oligonucleotide
guucaggucacaggccagcu

SEQ ID NO: 549 - RNA, 20 nt, Artificial Sequence
  Description of Artificial Sequence: Synthetic oligonucleotide
ugguucaggucacaggccag

SEQ ID NO: 550 - RNA, 20 nt, Artificial Sequence
  Description of Artificial Sequence: Synthetic oligonucleotide
augguucaggucacaggcca

SEQ ID NO: 551 - RNA, 20 nt, Artificial Sequence
  Description of Artificial Sequence: Synthetic oligonucleotide
caugguucaggucacaggcc

SEQ ID NO: 552 - RNA, 20 nt, Artificial Sequence
  Description of Artificial Sequence: Synthetic oligonucleotide
gagcaugguucaggucacag

SEQ ID NO: 553 - RNA, 20 nt, Artificial Sequence
  Description of Artificial Sequence: Synthetic oligonucleotide
ggagcaugguucaggucaca

SEQ ID NO: 554 - RNA, 20 nt, Artificial Sequence
  Description of Artificial Sequence: Synthetic oligonucleotide
caaggagcaugguucagguc

SEQ ID NO: 555 - RNA, 20 nt, Artificial Sequence
  Description of Artificial Sequence: Synthetic oligonucleotide
gcaaggagcaugguucaggu

SEQ ID NO: 556 - RNA, 20 nt, Artificial Sequence
  Description of Artificial Sequence: Synthetic oligonucleotide
ugcaaggagcaugguucagg

SEQ ID NO: 557 - RNA, 20 nt, Artificial Sequence
  Description of Artificial Sequence: Synthetic oligonucleotide
cuuucuggaugcaaggagca

SEQ ID NO: 558 - RNA, 20 nt, Artificial Sequence
  Description of Artificial Sequence: Synthetic oligonucleotide
gcuuucuggaugcaaggagc

SEQ ID NO: 559 - RNA, 20 nt, Artificial Sequence
  Description of Artificial Sequence: Synthetic oligonucleotide
gcagcuuucuggaugcaagg

SEQ ID NO: 560 - RNA, 20 nt, Artificial Sequence
  Description of Artificial Sequence: Synthetic oligonucleotide
agcagcuuucuggaugcaag

SEQ ID NO: 561 - RNA, 20 nt, Artificial Sequence
  Description of Artificial Sequence: Synthetic oligonucleotide
cagcagcuuucuggaugcaa

SEQ ID NO: 562 - RNA, 20 nt, Artificial Sequence
  Description of Artificial Sequence: Synthetic oligonucleotide
ucagcagcuuucuggaugca

SEQ ID NO: 563 - RNA, 20 nt, Artificial Sequence
  Description of Artificial Sequence: Synthetic oligonucleotide
gaguucagcagcuuucugga

SEQ ID NO: 564 - RNA, 20 nt, Artificial Sequence
  Description of Artificial Sequence: Synthetic oligonucleotide
aagaguucagcagcuuucug

SEQ ID NO: 565 - RNA, 20 nt, Artificial Sequence
  Description of Artificial Sequence: Synthetic oligonucleotide
agaagaguucagcagcuuuc

SEQ ID NO: 566 - RNA, 20 nt, Artificial Sequence
  Description of Artificial Sequence: Synthetic oligonucleotide
gagaagaguucagcagcuuu

SEQ ID NO: 567 - RNA, 20 nt, Artificial Sequence
  Description of Artificial Sequence: Synthetic oligonucleotide
ugagcacccacagaauacac

SEQ ID NO: 568 - RNA, 20 nt, Artificial Sequence
  Description of Artificial Sequence: Synthetic oligonucleotide
uguugucugagcacccacag

SEQ ID NO: 569 - RNA, 20 nt, Artificial Sequence
  Description of Artificial Sequence: Synthetic oligonucleotide
cuguugucugagcacccaca

SEQ ID NO: 570 - RNA, 20 nt, Artificial Sequence
  Description of Artificial Sequence: Synthetic oligonucleotide
gcuguugucugagcacccac

SEQ ID NO: 571 - RNA, 20 nt, Artificial Sequence
  Description of Artificial Sequence: Synthetic oligonucleotide
aaaagguaauuccauccugc

SEQ ID NO: 572 - RNA, 20 nt, Artificial Sequence
  Description of Artificial Sequence: Synthetic oligonucleotide
cacuugacauugacaguuca

SEQ ID NO: 573 - RNA, 20 nt, Artificial Sequence
  Description of Artificial Sequence: Synthetic oligonucleotide
gcacuugacauugacaguuc

SEQ ID NO: 574 - RNA, 20 nt, Artificial Sequence
  Description of Artificial Sequence: Synthetic oligonucleotide
agcacuugacauugacaguu

SEQ ID NO: 575 - RNA, 20 nt, Artificial Sequence
  Description of Artificial Sequence: Synthetic oligonucleotide
uucagcacuugacauugaca

SEQ ID NO: 576 - RNA, 20 nt, Artificial Sequence
  Description of Artificial Sequence: Synthetic oligonucleotide
uguucagcacuugacauuga

SEQ ID NO: 577 - RNA, 20 nt, Artificial Sequence
  Description of Artificial Sequence: Synthetic oligonucleotide
uuguucagcacuugacauug

SEQ ID NO: 578 - RNA, 20 nt, Artificial Sequence
  Description of Artificial Sequence: Synthetic oligonucleotide
cucguugacaaagcauacag

SEQ ID NO: 579 - RNA, 20 nt, Artificial Sequence
  Description of Artificial Sequence: Synthetic oligonucleotide
gcucguugacaaagcauaca

SEQ ID NO: 580 - RNA, 20 nt, Artificial Sequence
  Description of Artificial Sequence: Synthetic oligonucleotide
augcuugcucguugacaaag

SEQ ID NO: 581 - RNA, 20 nt, Artificial Sequence
  Description of Artificial Sequence: Synthetic oligonucleotide
gaugcuugcucguugacaaa

SEQ ID NO: 582 - RNA, 20 nt, Artificial Sequence
  Description of Artificial Sequence: Synthetic oligonucleotide
ugaugcuugcucguugacaa

SEQ ID NO: 583 - RNA, 20 nt, Artificial Sequence
  Description of Artificial Sequence: Synthetic oligonucleotide
cugaugcuugcucguugaca

SEQ ID NO: 584 - RNA, 20 nt, Artificial Sequence
  Description of Artificial Sequence: Synthetic oligonucleotide
ccugaugcuugcucguugac

SEQ ID NO: 585 - RNA, 20 nt, Artificial Sequence
  Description of Artificial Sequence: Synthetic oligonucleotide
uccugaugcuugcucguuga

SEQ ID NO: 586 - RNA, 20 nt, Artificial Sequence
  Description of Artificial Sequence: Synthetic oligonucleotide
uuccugaugcuugcucguug

SEQ ID NO: 587 - RNA, 20 nt, Artificial Sequence
  Description of Artificial Sequence: Synthetic oligonucleotide
uuuccugaugcuugcucguu

SEQ ID NO: 588 - RNA, 20 nt, Artificial Sequence
  Description of Artificial Sequence: Synthetic oligonucleotide
uuuuccugaugcuugcucgu

SEQ ID NO: 589 - RNA, 20 nt, Artificial Sequence
  Description of Artificial Sequence: Synthetic oligonucleotide
cuuuuccugaugcuugcucg

SEQ ID NO: 590 - RNA, 20 nt, Artificial Sequence
  Description of Artificial Sequence: Synthetic oligonucleotide
cuugauaaccuuuccuucca

SEQ ID NO: 591 - RNA, 20 nt, Artificial Sequence
  Description of Artificial Sequence: Synthetic oligonucleotide
ucuugauaaccuuuccuucc

SEQ ID NO: 592 - RNA, 20 nt, Artificial Sequence
  Description of Artificial Sequence: Synthetic oligonucleotide
gucuugauaaccuuuccuuc

SEQ ID NO: 593 - RNA, 20 nt, Artificial Sequence
  Description of Artificial Sequence: Synthetic oligonucleotide
gugucuugauaaccuuuccu

SEQ ID NO: 594 - RNA, 20 nt, Artificial Sequence
  Description of Artificial Sequence: Synthetic oligonucleotide
guucugugucuugauaaccu

SEQ ID NO: 595 - RNA, 20 nt, Artificial Sequence
  Description of Artificial Sequence: Synthetic oligonucleotide
gcugccaaguucugugucuu

SEQ ID NO: 596 - RNA, 20 nt, Artificial Sequence
  Description of Artificial Sequence: Synthetic oligonucleotide
agcugccaaguucugugucu

SEQ ID NO: 597 - RNA, 20 nt, Artificial Sequence
  Description of Artificial Sequence: Synthetic oligonucleotide
agagcugccaaguucugugu

SEQ ID NO: 598 - RNA, 20 nt, Artificial Sequence
  Description of Artificial Sequence: Synthetic oligonucleotide
ggagagcugccaaguucugu

SEQ ID NO: 599 - RNA, 20 nt, Artificial Sequence
  Description of Artificial Sequence: Synthetic oligonucleotide
aaggagagcugccaaguucu

SEQ ID NO: 600 - RNA, 20 nt, Artificial Sequence
  Description of Artificial Sequence: Synthetic oligonucleotide
gaaggagagcugccaaguuc

SEQ ID NO: 601 - RNA, 20 nt, Artificial Sequence
  Description of Artificial Sequence: Synthetic oligonucleotide
augaaggagagcugccaagu

SEQ ID NO: 602 - RNA, 20 nt, Artificial Sequence
  Description of Artificial Sequence: Synthetic oligonucleotide
caugaaggagagcugccaag

SEQ ID NO: 603 - RNA, 20 nt, Artificial Sequence
  Description of Artificial Sequence: Synthetic oligonucleotide
gcaugaaggagagcugccaa

SEQ ID NO: 604 - RNA, 20 nt, Artificial Sequence
  Description of Artificial Sequence: Synthetic oligonucleotide
cgcaugaaggagagcugcca

SEQ ID NO: 605 - RNA, 20 nt, Artificial Sequence
  Description of Artificial Sequence: Synthetic oligonucleotide
ucgcaugaaggagagcugcc

SEQ ID NO: 606 - RNA, 20 nt, Artificial Sequence
  Description of Artificial Sequence: Synthetic oligonucleotide
aucgcaugaaggagagcugc

SEQ ID NO: 607 - RNA, 20 nt, Artificial Sequence
  Description of Artificial Sequence: Synthetic oligonucleotide
caaucgcaugaaggagagcu

SEQ ID NO: 608 - RNA, 20 nt, Artificial Sequence
  Description of Artificial Sequence: Synthetic oligonucleotide
gcaaucgcaugaaggagagc

SEQ ID NO: 609 - RNA, 20 nt, Artificial Sequence
  Description of Artificial Sequence: Synthetic oligonucleotide
ggcaaucgcaugaaggagag

SEQ ID NO: 610 - RNA, 20 nt, Artificial Sequence
  Description of Artificial Sequence: Synthetic oligonucleotide
cuggcaaucgcaugaaggag

SEQ ID NO: 611 - RNA, 20 nt, Artificial Sequence
  Description of Artificial Sequence: Synthetic oligonucleotide
ucuggcaaucgcaugaagga

SEQ ID NO: 612 - RNA, 20 nt, Artificial Sequence
  Description of Artificial Sequence: Synthetic oligonucleotide
gucuggcaaucgcaugaagg

SEQ ID NO: 613 - RNA, 20 nt, Artificial Sequence
  Description of Artificial Sequence: Synthetic oligonucleotide
cgucuggcaaucgcaugaag

SEQ ID NO: 614 - RNA, 20 nt, Artificial Sequence
  Description of Artificial Sequence: Synthetic oligonucleotide
acgucuggcaaucgcaugaa

SEQ ID NO: 615 - RNA, 20 nt, Artificial Sequence
  Description of Artificial Sequence: Synthetic oligonucleotide
ucucuuacaaaaucccaugc

SEQ ID NO: 616 - RNA, 20 nt, Artificial Sequence
  Description of Artificial Sequence: Synthetic oligonucleotide
agaagauggguccaauuuuc

SEQ ID NO: 617 - RNA, 20 nt, Artificial Sequence
  Description of Artificial Sequence: Synthetic oligonucleotide
cagaagauggguccaauuuu

SEQ ID NO: 618 - RNA, 20 nt, Artificial Sequence
  Description of Artificial Sequence: Synthetic oligonucleotide
ucagaagauggguccaauuu

SEQ ID NO: 619 - RNA, 20 nt, Artificial Sequence
  Description of Artificial Sequence: Synthetic oligonucleotide
uucagaagauggguccaauu

SEQ ID NO: 620 - RNA, 20 nt, Artificial Sequence
  Description of Artificial Sequence: Synthetic oligonucleotide
aagugagcuguugugccaga

SEQ ID NO: 621 - RNA, 20 nt, Artificial Sequence
  Description of Artificial Sequence: Synthetic oligonucleotide
agaaaagugagcuguugugc

SEQ ID NO: 622 - RNA, 20 nt, Artificial Sequence
  Description of Artificial Sequence: Synthetic oligonucleotide
gaagaaaagugagcuguugu

SEQ ID NO: 623 - RNA, 20 nt, Artificial Sequence
  Description of Artificial Sequence: Synthetic oligonucleotide
gagccucaagagauucaaaa

SEQ ID NO: 624 - RNA, 20 nt, Artificial Sequence
  Description of Artificial Sequence: Synthetic oligonucleotide
ugagccucaagagauucaaa

SEQ ID NO: 625 - RNA, 20 nt, Artificial Sequence
  Description of Artificial Sequence: Synthetic oligonucleotide
cagaugugauccuugagccu

SEQ ID NO: 626 - RNA, 20 nt, Artificial Sequence
  Description of Artificial Sequence: Synthetic oligonucleotide
ccagaugugauccuugagcc

SEQ ID NO: 627 - RNA, 20 nt, Artificial Sequence
  Description of Artificial Sequence: Synthetic oligonucleotide
uccagaugugauccuugagc

SEQ ID NO: 628 - RNA, 20 nt, Artificial Sequence
  Description of Artificial Sequence: Synthetic oligonucleotide
guuaucguuuccagaacagu

SEQ ID NO: 629 - RNA, 20 nt, Artificial Sequence
  Description of Artificial Sequence: Synthetic oligonucleotide
gguuaucguuuccagaacag

SEQ ID NO: 630 - RNA, 20 nt, Artificial Sequence
  Description of Artificial Sequence: Synthetic oligonucleotide
ugguuaucguuuccagaaca

SEQ ID NO: 631 - RNA, 20 nt, Artificial Sequence
  Description of Artificial Sequence: Synthetic oligonucleotide
uugguuaucguuuccagaac

SEQ ID NO: 632 - RNA, 20 nt, Artificial Sequence
  Description of Artificial Sequence: Synthetic oligonucleotide
uaaccauuagccaaguccuc

SEQ ID NO: 633 - RNA, 20 nt, Artificial Sequence
  Description of Artificial Sequence: Synthetic oligonucleotide
uuaaccauuagccaaguccu

SEQ ID NO: 634 - RNA, 20 nt, Artificial Sequence
  Description of Artificial Sequence: Synthetic oligonucleotide
auuaaccauuagccaagucc

SEQ ID NO: 635 - RNA, 20 nt, Artificial Sequence
  Description of Artificial Sequence: Synthetic oligonucleotide
auuacaggcgugagccaccg

SEQ ID NO: 636 - RNA, 20 nt, Artificial Sequence
  Description of Artificial Sequence: Synthetic oligonucleotide
gauuacaggcgugagccacc

SEQ ID NO: 637 - RNA, 20 nt, Artificial Sequence
  Description of Artificial Sequence: Synthetic oligonucleotide
ggauuacaggcgugagccac

SEQ ID NO: 638 - RNA, 20 nt, Artificial Sequence
  Description of Artificial Sequence: Synthetic oligonucleotide
gggauuacaggcgugagcca

SEQ ID NO: 639 - RNA, 20 nt, Artificial Sequence
  Description of Artificial Sequence: Synthetic oligonucleotide
ugggauuacaggcgugagcc

SEQ ID NO: 640 - RNA, 20 nt, Artificial Sequence
  Description of Artificial Sequence: Synthetic oligonucleotide
cugggauuacaggcgugagc

SEQ ID NO: 641 - RNA, 20 nt, Artificial Sequence
  Description of Artificial Sequence: Synthetic oligonucleotide
gcugggauuacaggcgugag

SEQ ID NO: 642 - RNA, 20 nt, Artificial Sequence
  Description of Artificial Sequence: Synthetic oligonucleotide
ugcugggauuacaggcguga

SEQ ID NO: 643 - RNA, 20 nt, Artificial Sequence
  Description of Artificial Sequence: Synthetic oligonucleotide
gugcugggauuacaggcgug

SEQ ID NO: 644 - RNA, 20 nt, Artificial Sequence
  Description of Artificial Sequence: Synthetic oligonucleotide
agugcugggauuacaggcgu

SEQ ID NO: 645 - RNA, 20 nt, Artificial Sequence
  Description of Artificial Sequence: Synthetic oligonucleotide
aagugcugggauuacaggcg

SEQ ID NO: 646 - RNA, 20 nt, Artificial Sequence
  Description of Artificial Sequence: Synthetic oligonucleotide
aaagugcugggauuacaggc

SEQ ID NO: 647 - RNA, 20 nt, Artificial Sequence
  Description of Artificial Sequence: Synthetic oligonucleotide
caaagugcugggauuacagg

SEQ ID NO: 648 - RNA, 20 nt, Artificial Sequence
  Description of Artificial Sequence: Synthetic oligonucleotide
ccaaagugcugggauuacag

SEQ ID NO: 649 - RNA, 20 nt, Artificial Sequence
  Description of Artificial Sequence: Synthetic oligonucleotide
ucucagccucccaaagugcu

SEQ ID NO: 650 - RNA, 20 nt, Artificial Sequence
  Description of Artificial Sequence: Synthetic oligonucleotide
uucucagccucccaaagugc

SEQ ID NO: 651 - RNA, 20 nt, Artificial Sequence
  Description of Artificial Sequence: Synthetic oligonucleotide
cuucucagccucccaaagug

SEQ ID NO: 652 - RNA, 20 nt, Artificial Sequence
  Description of Artificial Sequence: Synthetic oligonucleotide
ccuucucagccucccaaagu

SEQ ID NO: 653 - RNA, 20 nt, Artificial Sequence
  Description of Artificial Sequence: Synthetic oligonucleotide
cccuucucagccucccaaag

SEQ ID NO: 654 - RNA, 20 nt, Artificial Sequence
  Description of Artificial Sequence: Synthetic oligonucleotide
aucuccugaccucgugaucc

SEQ ID NO: 655 - RNA, 20 nt, Artificial Sequence
  Description of Artificial Sequence: Synthetic oligonucleotide
caucuccugaccucgugauc

SEQ ID NO: 656 - RNA, 20 nt, Artificial Sequence
  Description of Artificial Sequence: Synthetic oligonucleotide
ccaucuccugaccucgugau

SEQ ID NO: 657 - RNA, 20 nt, Artificial Sequence
  Description of Artificial Sequence: Synthetic oligonucleotide
uccaucuccugaccucguga

SEQ ID NO: 658 - RNA, 20 nt, Artificial Sequence
  Description of Artificial Sequence: Synthetic oligonucleotide
cuccaucuccugaccucgug

SEQ ID NO: 659 - RNA, 20 nt, Artificial Sequence
  Description of Artificial Sequence: Synthetic oligonucleotide
ucuccaucuccugaccucgu

SEQ ID NO: 660 - RNA, 20 nt, Artificial Sequence
  Description of Artificial Sequence: Synthetic oligonucleotide
cucaccguguuagccaggau

SEQ ID NO: 661 - RNA, 20 nt, Artificial Sequence
  Description of Artificial Sequence: Synthetic oligonucleotide
ucucaccguguuagccagga

SEQ ID NO: 662 - RNA, 20 nt, Artificial Sequence
  Description of Artificial Sequence: Synthetic oligonucleotide
gucucaccguguuagccagg

SEQ ID NO: 663 - RNA, 20 nt, Artificial Sequence
  Description of Artificial Sequence: Synthetic oligonucleotide
ggucucaccguguuagccag

SEQ ID NO: 664 - RNA, 20 nt, Artificial Sequence
  Description of Artificial Sequence: Synthetic oligonucleotide
gggucucaccguguuagcca

SEQ ID NO: 665 - RNA, 20 nt, Artificial Sequence
  Description of Artificial Sequence: Synthetic oligonucleotide
uacaggcaccugccaccaug

SEQ ID NO: 666 - RNA, 20 nt, Artificial Sequence
  Description of Artificial Sequence: Synthetic oligonucleotide
cuacaggcaccugccaccau

SEQ ID NO: 667 - RNA, 20 nt, Artificial Sequence
  Description of Artificial Sequence: Synthetic oligonucleotide
acuacaggcaccugccacca

SEQ ID NO: 668 - RNA, 20 nt, Artificial Sequence
  Description of Artificial Sequence: Synthetic oligonucleotide
agcugggacuacaggcaccu

SEQ ID NO: 669 - RNA, 20 nt, Artificial Sequence
  Description of Artificial Sequence: Synthetic oligonucleotide
uagcugggacuacaggcacc

SEQ ID NO: 670 - RNA, 20 nt, Artificial Sequence
  Description of Artificial Sequence: Synthetic oligonucleotide
cugccgaguagcugggacua

SEQ ID NO: 671 - RNA, 20 nt, Artificial Sequence
  Description of Artificial Sequence: Synthetic oligonucleotide
cucacugcaagcuccaccuc

SEQ ID NO: 672 - RNA, 20 nt, Artificial Sequence
  Description of Artificial Sequence: Synthetic oligonucleotide
gcucacugcaagcuccaccu

SEQ ID NO: 673 - RNA, 20 nt, Artificial Sequence
  Description of Artificial Sequence: Synthetic oligonucleotide
ucggcucacugcaagcucca

SEQ ID NO: 674 - RNA, 20 nt, Artificial Sequence
  Description of Artificial Sequence: Synthetic oligonucleotide
ucucggcucacugcaagcuc

SEQ ID NO: 675 - RNA, 20 nt, Artificial Sequence
  Description of Artificial Sequence: Synthetic oligonucleotide
aucucggcucacugcaagcu

SEQ ID NO: 676 - RNA, 20 nt, Artificial Sequence
  Description of Artificial Sequence: Synthetic oligonucleotide
aaucucggcucacugcaagc

SEQ ID NO: 677 - RNA, 20 nt, Artificial Sequence
  Description of Artificial Sequence: Synthetic oligonucleotide
caaucucggcucacugcaag

SEQ ID NO: 678 - RNA, 20 nt, Artificial Sequence
  Description of Artificial Sequence: Synthetic oligonucleotide
gcaaucucggcucacugcaa

SEQ ID NO: 679 - RNA, 20 nt, Artificial Sequence
  Description of Artificial Sequence: Synthetic oligonucleotide
gugcaaucucggcucacugc

SEQ ID NO: 680 - RNA, 20 nt, Artificial Sequence
  Description of Artificial Sequence: Synthetic oligonucleotide
ggugcaaucucggcucacug

SEQ ID NO: 681 - RNA, 20 nt, Artificial Sequence
  Description of Artificial Sequence: Synthetic oligonucleotide
uggugcaaucucggcucacu

SEQ ID NO: 682 - RNA, 20 nt, Artificial Sequence
  Description of Artificial Sequence: Synthetic oligonucleotide
guggugcaaucucggcucac

SEQ ID NO: 683 - RNA, 20 nt, Artificial Sequence
  Description of Artificial Sequence: Synthetic oligonucleotide
aguggugcaaucucggcuca

SEQ ID NO: 684 - RNA, 20 nt, Artificial Sequence
  Description of Artificial Sequence: Synthetic oligonucleotide
caguggugcaaucucggcuc

SEQ ID NO: 685 - RNA, 20 nt, Artificial Sequence
  Description of Artificial Sequence: Synthetic oligonucleotide
gcaguggugcaaucucggcu

SEQ ID NO: 686 - RNA, 20 nt, Artificial Sequence
  Description of Artificial Sequence: Synthetic oligonucleotide
aggcuggaaugcaguggugc

SEQ ID NO: 687 - RNA, 20 nt, Artificial Sequence
  Description of Artificial Sequence: Synthetic oligonucleotide
caggcuggaaugcaguggug

SEQ ID NO: 688 - RNA, 20 nt, Artificial Sequence
  Description of Artificial Sequence: Synthetic oligonucleotide
ccaggcuggaaugcaguggu

SEQ ID NO: 689 - RNA, 20 nt, Artificial Sequence
  Description of Artificial Sequence: Synthetic oligonucleotide
acccaggcuggaaugcagug

SEQ ID NO: 690 - RNA, 20 nt, Artificial Sequence
  Description of Artificial Sequence: Synthetic oligonucleotide
cacccaggcuggaaugcagu

SEQ ID NO: 691 - RNA, 20 nt, Artificial Sequence
  Description of Artificial Sequence: Synthetic oligonucleotide
ucacccaggcuggaaugcag

SEQ ID NO: 692 - RNA, 20 nt, Artificial Sequence
  Description of Artificial Sequence: Synthetic oligonucleotide
gucacccaggcuggaaugca

SEQ ID NO: 693 - RNA, 20 nt, Artificial Sequence
  Description of Artificial Sequence: Synthetic oligonucleotide
agucacccaggcuggaaugc

SEQ ID NO: 694 - RNA, 20 nt, Artificial Sequence
  Description of Artificial Sequence: Synthetic oligonucleotide
cagucacccaggcuggaaug

SEQ ID NO: 695 - RNA, 20 nt, Artificial Sequence
  Description of Artificial Sequence: Synthetic oligonucleotide
ucagucacccaggcuggaau

SEQ ID NO: 696 - RNA, 20 nt, Artificial Sequence
  Description of Artificial Sequence: Synthetic oligonucleotide
cucagucacccaggcuggaa

SEQ ID NO: 697 - RNA, 20 nt, Artificial Sequence
  Description of Artificial Sequence: Synthetic oligonucleotide
gacagagucucgcucaguca

SEQ ID NO: 698 - RNA, 20 nt, Artificial Sequence
  Description of Artificial Sequence: Synthetic oligonucleotide
gucaugucugauguaccuuu

SEQ ID NO: 699 - RNA, 20 nt, Artificial Sequence
  Description of Artificial Sequence: Synthetic oligonucleotide
agucaugucugauguaccuu

SEQ ID NO: 700 - RNA, 20 nt, Artificial Sequence
  Description of Artificial Sequence: Synthetic oligonucleotide
cagucaugucugauguaccu

SEQ ID NO: 701 - RNA, 20 nt, Artificial Sequence
  Description of Artificial Sequence: Synthetic oligonucleotide
gcagucaugucugauguacc

SEQ ID NO: 702 - RNA, 20 nt, Artificial Sequence
  Description of Artificial Sequence: Synthetic oligonucleotide
ggcagucaugucugauguac

SEQ ID NO: 703 - RNA, 20 nt, Artificial Sequence
  Description of Artificial Sequence: Synthetic oligonucleotide
aggcagucaugucugaugua

SEQ ID NO: 704 - RNA, 20 nt, Artificial Sequence
  Description of Artificial Sequence: Synthetic oligonucleotide
caggcagucaugucugaugu

SEQ ID NO: 705 - RNA, 20 nt, Artificial Sequence
  Description of Artificial Sequence: Synthetic oligonucleotide
gcaggcagucaugucugaug

SEQ ID NO: 706 - RNA, 20 nt, Artificial Sequence
  Description of Artificial Sequence: Synthetic oligonucleotide
ugcaggcagucaugucugau

SEQ ID NO: 707 - RNA, 20 nt, Artificial Sequence
  Description of Artificial Sequence: Synthetic oligonucleotide
cuguuugacuucaugcaggc

SEQ ID NO: 708 - RNA, 20 nt, Artificial Sequence
  Description of Artificial Sequence: Synthetic oligonucleotide
uacccuguuugacuucaugc

SEQ ID NO: 709 - RNA, 20 nt, Artificial Sequence
  Description of Artificial Sequence: Synthetic oligonucleotide
guuacccuguuugacuucau

SEQ ID NO: 710 - RNA, 20 nt, Artificial Sequence
  Description of Artificial Sequence: Synthetic oligonucleotide
gguguuacccuguuugacuu

SEQ ID NO: 711 - RNA, 20 nt, Artificial Sequence
  Description of Artificial Sequence: Synthetic oligonucleotide
ugguguuacccuguuugacu

SEQ ID NO: 712 - RNA, 20 nt, Artificial Sequence
  Description of Artificial Sequence: Synthetic oligonucleotide
cugguguuacccuguuugac

SEQ ID NO: 713 - RNA, 20 nt, Artificial Sequence
  Description of Artificial Sequence: Synthetic oligonucleotide
acugguguuacccuguuuga

SEQ ID NO: 714 - RNA, 20 nt, Artificial Sequence
  Description of Artificial Sequence: Synthetic oligonucleotide
cacugguguuacccuguuug

SEQ ID NO: 715 - RNA, 20 nt, Artificial Sequence
  Description of Artificial Sequence: Synthetic oligonucleotide
ucacugguguuacccuguuu

SEQ ID NO: 716 - RNA, 20 nt, Artificial Sequence
  Description of Artificial Sequence: Synthetic oligonucleotide
uucacugguguuacccuguu

SEQ ID NO: 717 - RNA, 20 nt, Artificial Sequence
  Description of Artificial Sequence: Synthetic oligonucleotide
cuucacugguguuacccugu

SEQ ID NO: 718 - RNA, 20 nt, Artificial Sequence
  Description of Artificial Sequence: Synthetic oligonucleotide
agcuucacugguguuacccu

SEQ ID NO: 719 - RNA, 20 nt, Artificial Sequence
  Description of Artificial Sequence: Synthetic oligonucleotide
uugagcuucacugguguuac

SEQ ID NO: 720 - RNA, 20 nt, Artificial Sequence
  Description of Artificial Sequence: Synthetic oligonucleotide
cuugagcuucacugguguua

SEQ ID NO: 721 - RNA, 20 nt, Artificial Sequence
  Description of Artificial Sequence: Synthetic oligonucleotide
acuugagcuucacugguguu

SEQ ID NO: 722 - RNA, 20 nt, Artificial Sequence
  Description of Artificial Sequence: Synthetic oligonucleotide
gacuugagcuucacuggugu

SEQ ID NO: 723 - RNA, 20 nt, Artificial Sequence
  Description of Artificial Sequence: Synthetic oligonucleotide
cucuugacuugagcuucacu

SEQ ID NO: 724 - RNA, 20 nt, Artificial Sequence
  Description of Artificial Sequence: Synthetic oligonucleotide
uccacagcucuugacuugag

SEQ ID NO: 725 - RNA, 20 nt, Artificial Sequence
  Description of Artificial Sequence: Synthetic oligonucleotide
auccacagcucuugacuuga

SEQ ID NO: 726 - RNA, 20 nt, Artificial Sequence
  Description of Artificial Sequence: Synthetic oligonucleotide
uauccacagcucuugacuug

SEQ ID NO: 727 - RNA, 20 nt, Artificial Sequence
  Description of Artificial Sequence: Synthetic oligonucleotide
gacaaaauauccacagcucu

SEQ ID NO: 728 - RNA, 20 nt, Artificial Sequence
  Description of Artificial Sequence: Synthetic oligonucleotide
agacaaaauauccacagcuc

SEQ ID NO: 729 - RNA, 20 nt, Artificial Sequence
  Description of Artificial Sequence: Synthetic oligonucleotide
gacuucuuguugguuagaca

SEQ ID NO: 730 - RNA, 20 nt, Artificial Sequence
  Description of Artificial Sequence: Synthetic oligonucleotide
ugagacuucuuguugguuag

SEQ ID NO: 731 - RNA, 20 nt, Artificial Sequence
  Description of Artificial Sequence: Synthetic oligonucleotide
cuugagacuucuuguugguu

SEQ ID NO: 732 - RNA, 20 nt, Artificial Sequence
  Description of Artificial Sequence: Synthetic oligonucleotide
ucuugagacuucuuguuggu

SEQ ID NO: 733 - RNA, 20 nt, Artificial Sequence
  Description of Artificial Sequence: Synthetic oligonucleotide
uucuugagacuucuuguugg

SEQ ID NO: 734 - RNA, 20 nt, Artificial Sequence
  Description of Artificial Sequence: Synthetic oligonucleotide
gccugauuucuugagacuuc

SEQ ID NO: 735 - RNA, 20 nt, Artificial Sequence
  Description of Artificial Sequence: Synthetic oligonucleotide
ugccugauuucuugagacuu

SEQ ID NO: 736 - RNA, 20 nt, Artificial Sequence
  Description of Artificial Sequence: Synthetic oligonucleotide
caucuuuuggcuggauacga

SEQ ID NO: 737 - RNA, 20 nt, Artificial Sequence
  Description of Artificial Sequence: Synthetic oligonucleotide
gcaucuuuuggcuggauacg

SEQ ID NO: 738 - RNA, 20 nt, Artificial Sequence
  Description of Artificial Sequence: Synthetic oligonucleotide
ccaccacuccaucaucaugc

SEQ ID NO: 739 - RNA, 20 nt, Artificial Sequence
  Description of Artificial Sequence: Synthetic oligonucleotide
cccaccacuccaucaucaug

SEQ ID NO: 740 - RNA, 20 nt, Artificial Sequence
  Description of Artificial Sequence: Synthetic oligonucleotide
gauacugaacuggccuuccc

SEQ ID NO: 741 - RNA, 20 nt, Artificial Sequence
  Description of Artificial Sequence: Synthetic oligonucleotide
uaggauacugaacuggccuu

SEQ ID NO: 742 - RNA, 20 nt, Artificial Sequence
  Description of Artificial Sequence: Synthetic oligonucleotide
auaggauacugaacuggccu

SEQ ID NO: 743 - RNA, 20 nt, Artificial Sequence
  Description of Artificial Sequence: Synthetic oligonucleotide
aauaggauacugaacuggcc

SEQ ID NO: 744 - RNA, 20 nt, Artificial Sequence
  Description of Artificial Sequence: Synthetic oligonucleotide
aaauaggauacugaacuggc

SEQ ID NO: 745 - RNA, 20 nt, Artificial Sequence
  Description of Artificial Sequence: Synthetic oligonucleotide
ggagaaagucacuugaggcu

SEQ ID NO: 746 - RNA, 20 nt, Artificial Sequence
  Description of Artificial Sequence: Synthetic oligonucleotide
uggagaaagucacuugaggc

SEQ ID NO: 747 - RNA, 20 nt, Artificial Sequence
  Description of Artificial Sequence: Synthetic oligonucleotide
aauggagaaagucacuugag

SEQ ID NO: 748 - RNA, 20 nt, Artificial Sequence
  Description of Artificial Sequence: Synthetic oligonucleotide
agcaauggagaaagucacuu

SEQ ID NO: 749 - RNA, 20 nt, Artificial Sequence
  Description of Artificial Sequence: Synthetic oligonucleotide
uagcgugaagcaauggagaa

SEQ ID NO: 750 - RNA, 20 nt, Artificial Sequence
  Description of Artificial Sequence: Synthetic oligonucleotide
auagcgugaagcaauggaga

SEQ ID NO: 751 - RNA, 20 nt, Artificial Sequence
  Description of Artificial Sequence: Synthetic oligonucleotide
cauagcgugaagcaauggag

SEQ ID NO: 752 - RNA, 20 nt, Artificial Sequence
  Description of Artificial Sequence: Synthetic oligonucleotide
gcauagcgugaagcaaugga

SEQ ID NO: 753 - RNA, 20 nt, Artificial Sequence
  Description of Artificial Sequence: Synthetic oligonucleotide
ggcauagcgugaagcaaugg

SEQ ID NO: 754 - RNA, 20 nt, Artificial Sequence
  Description of Artificial Sequence: Synthetic oligonucleotide
uggcauagcgugaagcaaug

SEQ ID NO: 755 - RNA, 20 nt, Artificial Sequence
  Description of Artificial Sequence: Synthetic oligonucleotide
guggcauagcgugaagcaau

SEQ ID NO: 756 - RNA, 20 nt, Artificial Sequence
  Description of Artificial Sequence: Synthetic oligonucleotide
aguggcauagcgugaagcaa

SEQ ID NO: 757 - RNA, 20 nt, Artificial Sequence
  Description of Artificial Sequence: Synthetic oligonucleotide
uaguggcauagcgugaagca

SEQ ID NO: 758 - RNA, 20 nt, Artificial Sequence
  Description of Artificial Sequence: Synthetic oligonucleotide
auaguggcauagcgugaagc

SEQ ID NO: 759 - RNA, 20 nt, Artificial Sequence
  Description of Artificial Sequence: Synthetic oligonucleotide
aauaguggcauagcgugaag

SEQ ID NO: 760 - RNA, 20 nt, Artificial Sequence
  Description of Artificial Sequence: Synthetic oligonucleotide
aaauaguggcauagcgugaa

SEQ ID NO: 761 - RNA, 20 nt, Artificial Sequence
  Description of Artificial Sequence: Synthetic oligonucleotide
aaaauaguggcauagcguga

SEQ ID NO: 762 - RNA, 20 nt, Artificial Sequence
  Description of Artificial Sequence: Synthetic oligonucleotide
gcaaaauaguggcauagcgu

SEQ ID NO: 763 - RNA, 20 nt, Artificial Sequence
  Description of Artificial Sequence: Synthetic oligonucleotide
agcaaaauaguggcauagcg

SEQ ID NO: 764 - RNA, 20 nt, Artificial Sequence
  Description of Artificial Sequence: Synthetic oligonucleotide
aagcaaaauaguggcauagc

SEQ ID NO: 765 - RNA, 20 nt, Artificial Sequence
  Description of Artificial Sequence: Synthetic oligonucleotide
aacugguugggcaaacuaua

SEQ ID NO: 766 - RNA, 20 nt, Artificial Sequence
  Description of Artificial Sequence: Synthetic oligonucleotide
aaacugguugggcaaacuau

SEQ ID NO: 767 - RNA, 20 nt, Artificial Sequence
  Description of Artificial Sequence: Synthetic oligonucleotide
aaaacugguugggcaaacua

SEQ ID NO: 768 - RNA, 20 nt, Artificial Sequence
  Description of Artificial Sequence: Synthetic oligonucleotide
uaaaacugguugggcaaacu

SEQ ID NO: 769 - RNA, 20 nt, Artificial Sequence
  Description of Artificial Sequence: Synthetic oligonucleotide
guaaaacugguugggcaaac

SEQ ID NO: 770 - RNA, 20 nt, Artificial Sequence
  Description of Artificial Sequence: Synthetic oligonucleotide
cguaaaacugguugggcaaa

SEQ ID NO: 771 - RNA, 20 nt, Artificial Sequence
  Description of Artificial Sequence: Synthetic oligonucleotide
gacguaaaacugguugggca

SEQ ID NO: 772 - RNA, 20 nt, Artificial Sequence
  Description of Artificial Sequence: Synthetic oligonucleotide
ggacguaaaacugguugggc

SEQ ID NO: 773 - RNA, 20 nt, Artificial Sequence
  Description of Artificial Sequence: Synthetic oligonucleotide
uggacguaaaacugguuggg

SEQ ID NO: 774 - RNA, 20 nt, Artificial Sequence
  Description of Artificial Sequence: Synthetic oligonucleotide
uuggacguaaaacugguugg

SEQ ID NO: 775 - RNA, 20 nt, Artificial Sequence
  Description of Artificial Sequence: Synthetic oligonucleotide
cuuggacguaaaacugguug

SEQ ID NO: 776 - RNA, 20 nt, Artificial Sequence
  Description of Artificial Sequence: Synthetic oligonucleotide
ccuuggacguaaaacugguu

SEQ ID NO: 777 - RNA, 20 nt, Artificial Sequence
  Description of Artificial Sequence: Synthetic oligonucleotide
uccuuggacguaaaacuggu

SEQ ID NO: 778 - RNA, 20 nt, Artificial Sequence
  Description of Artificial Sequence: Synthetic oligonucleotide
uuccuuggacguaaaacugg

SEQ ID NO: 779 - RNA, 20 nt, Artificial Sequence
  Description of Artificial Sequence: Synthetic oligonucleotide
uuuccuuggacguaaaacug

SEQ ID NO: 780 - RNA, 20 nt, Artificial Sequence
  Description of Artificial Sequence: Synthetic oligonucleotide
ggcuaauuuuccuuggacgu

SEQ ID NO: 781 - RNA, 20 nt, Artificial Sequence
  Description of Artificial Sequence: Synthetic oligonucleotide
uggcuaauuuuccuuggacg

SEQ ID NO: 782 - RNA, 20 nt, Artificial Sequence
  Description of Artificial Sequence: Synthetic oligonucleotide
gcauuggcuaauuuuccuug

SEQ ID NO: 783 - RNA, 20 nt, Artificial Sequence
  Description of Artificial Sequence: Synthetic oligonucleotide
uuccugauccuugccuuuca

SEQ ID NO: 784 - RNA, 20 nt, Artificial Sequence
  Description of Artificial Sequence: Synthetic oligonucleotide
ucugguuuccugauccuugc

SEQ ID NO: 785 - RNA, 20 nt, Artificial Sequence
  Description of Artificial Sequence: Synthetic oligonucleotide
ucucugguuuccugauccuu

SEQ ID NO: 786 - RNA, 20 nt, Artificial Sequence
  Description of Artificial Sequence: Synthetic oligonucleotide
gucucugguuuccugauccu

SEQ ID NO: 787 - RNA, 20 nt, Artificial Sequence
  Description of Artificial Sequence: Synthetic oligonucleotide
agucucugguuuccugaucc

SEQ ID NO: 788 - RNA, 20 nt, Artificial Sequence
  Description of Artificial Sequence: Synthetic oligonucleotide
aagucucugguuuccugauc

SEQ ID NO: 789 - RNA, 20 nt, Artificial Sequence
  Description of Artificial Sequence: Synthetic oligonucleotide
ccugacaccuaguuucuaau

SEQ ID NO: 790 - RNA, 20 nt, Artificial Sequence
  Description of Artificial Sequence: Synthetic oligonucleotide
aacccugacaccuaguuucu

SEQ ID NO: 791 - RNA, 20 nt, Artificial Sequence
  Description of Artificial Sequence: Synthetic oligonucleotide
auaaacccugacaccuaguu

SEQ ID NO: 792 - RNA, 20 nt, Artificial Sequence
  Description of Artificial Sequence: Synthetic oligonucleotide
gauaaacccugacaccuagu

SEQ ID NO: 793 - RNA, 20 nt, Artificial Sequence
  Description of Artificial Sequence: Synthetic oligonucleotide
ugauaaacccugacaccuag

SEQ ID NO: 794 - RNA, 20 nt, Artificial Sequence
  Description of Artificial Sequence: Synthetic oligonucleotide
cuugauaaacccugacaccu

SEQ ID NO: 795 - RNA, 20 nt, Artificial Sequence
  Description of Artificial Sequence: Synthetic oligonucleotide
ucuugauaaacccugacacc

SEQ ID NO: 796 - RNA, 20 nt, Artificial Sequence
  Description of Artificial Sequence: Synthetic oligonucleotide
uucuugauaaacccugacac

SEQ ID NO: 797 - RNA, 20 nt, Artificial Sequence
  Description of Artificial Sequence: Synthetic oligonucleotide
cuucuugauaaacccugaca

SEQ ID NO: 798 - RNA, 20 nt, Artificial Sequence
  Description of Artificial Sequence: Synthetic oligonucleotide
ccuucuugauaaacccugac

SEQ ID NO: 799 - RNA, 20 nt, Artificial Sequence
  Description of Artificial Sequence: Synthetic oligonucleotide
gccuucuugauaaacccuga

SEQ ID NO: 800 - RNA, 20 nt, Artificial Sequence
  Description of Artificial Sequence: Synthetic oligonucleotide
ggccuucuugauaaacccug

SEQ ID NO: 801 - RNA, 20 nt, Artificial Sequence
  Description of Artificial Sequence: Synthetic oligonucleotide
uggccuucuugauaaacccu

SEQ ID NO: 802 - RNA, 20 nt, Artificial Sequence
  Description of Artificial Sequence: Synthetic oligonucleotide
uuccuggccuucuugauaaa

SEQ ID NO: 803 - RNA, 20 nt, Artificial Sequence
  Description of Artificial Sequence: Synthetic oligonucleotide
cagagaccauucauuuggaa

SEQ ID NO: 804 - RNA, 20 nt, Artificial Sequence
  Description of Artificial Sequence: Synthetic oligonucleotide
ccagagaccauucauuugga

SEQ ID NO: 805 - RNA, 20 nt, Artificial Sequence
  Description of Artificial Sequence: Synthetic oligonucleotide
accagagaccauucauuugg

SEQ ID NO: 806 - RNA, 20 nt, Artificial Sequence
  Description of Artificial Sequence: Synthetic oligonucleotide
ugaccagagaccauucauuu

SEQ ID NO: 807 - RNA, 20 nt, Artificial Sequence
  Description of Artificial Sequence: Synthetic oligonucleotide
uugaccagagaccauucauu

SEQ ID NO: 808 - RNA, 20 nt, Artificial Sequence
  Description of Artificial Sequence: Synthetic oligonucleotide
uuugaccagagaccauucau

SEQ ID NO: 809 - RNA, 20 nt, Artificial Sequence
  Description of Artificial Sequence: Synthetic oligonucleotide
auuugaccagagaccauuca

SEQ ID NO: 810 - RNA, 20 nt, Artificial Sequence
  Description of Artificial Sequence: Synthetic oligonucleotide
cauuugaccagagaccauuc

SEQ ID NO: 811 - RNA, 20 nt, Artificial Sequence
  Description of Artificial Sequence: Synthetic oligonucleotide
auucauuugaccagagacca

SEQ ID NO: 812 - RNA, 20 nt, Artificial Sequence
  Description of Artificial Sequence: Synthetic oligonucleotide
uuguaucucugugagggcag

SEQ ID NO: 813 - RNA, 20 nt, Artificial Sequence
  Description of Artificial Sequence: Synthetic oligonucleotide
guaaggcuuaaaccaaaugg

SEQ ID NO: 814 - RNA, 20 nt, Artificial Sequence
  Description of Artificial Sequence: Synthetic oligonucleotide
cagauucgacuucauuugga

SEQ ID NO: 815 - RNA, 20 nt, Artificial Sequence
  Description of Artificial Sequence: Synthetic oligonucleotide
ggcagauucgacuucauuug

SEQ ID NO: 816 - RNA, 20 nt, Artificial Sequence
  Description of Artificial Sequence: Synthetic oligonucleotide
gggcagauucgacuucauuu

SEQ ID NO: 817 - RNA, 20 nt, Artificial Sequence
  Description of Artificial Sequence: Synthetic oligonucleotide
agggcagauucgacuucauu

SEQ ID NO: 818 - RNA, 20 nt, Artificial Sequence
  Description of Artificial Sequence: Synthetic oligonucleotide
gagggcagauucgacuucau

SEQ ID NO: 819 - RNA, 20 nt, Artificial Sequence
  Description of Artificial Sequence: Synthetic oligonucleotide
ugagggcagauucgacuuca

SEQ ID NO: 820 - RNA, 20 nt, Artificial Sequence
  Description of Artificial Sequence: Synthetic oligonucleotide
gugagggcagauucgacuuc

SEQ ID NO: 821 - RNA, 20 nt, Artificial Sequence
  Description of Artificial Sequence: Synthetic oligonucleotide
ugugagggcagauucgacuu

SEQ ID NO: 822 - RNA, 20 nt, Artificial Sequence
  Description of Artificial Sequence: Synthetic oligonucleotide
cugugagggcagauucgacu

SEQ ID NO: 823 - RNA, 20 nt, Artificial Sequence
  Description of Artificial Sequence: Synthetic oligonucleotide
cuugugucucugugagggca

SEQ ID NO: 824 - RNA, 20 nt, Artificial Sequence
  Description of Artificial Sequence: Synthetic oligonucleotide
uucuugugucucugugaggg

SEQ ID NO: 825 - RNA, 20 nt, Artificial Sequence
  Description of Artificial Sequence: Synthetic oligonucleotide
auuucagagagcaagaagcg

SEQ ID NO: 826 - RNA, 20 nt, Artificial Sequence
  Description of Artificial Sequence: Synthetic oligonucleotide
cauuucagagagcaagaagc

SEQ ID NO: 827 - RNA, 20 nt, Artificial Sequence
  Description of Artificial Sequence: Synthetic oligonucleotide
ggcauuucagagagcaagaa

SEQ ID NO: 828 - RNA, 20 nt, Artificial Sequence
  Description of Artificial Sequence: Synthetic oligonucleotide
cauuuagcagggcauuucag

SEQ ID NO: 829 - RNA, 20 nt, Artificial Sequence
  Description of Artificial Sequence: Synthetic oligonucleotide
gcauuuagcagggcauuuca

SEQ ID NO: 830 - RNA, 20 nt, Artificial Sequence
  Description of Artificial Sequence: Synthetic oligonucleotide
agcauuuagcagggcauuuc

SEQ ID NO: 831 - RNA, 20 nt, Artificial Sequence
  Description of Artificial Sequence: Synthetic oligonucleotide
agaagcauuuagcagggcau

SEQ ID NO: 832 - RNA, 20 nt, Artificial Sequence
  Description of Artificial Sequence: Synthetic oligonucleotide
gagaagcauuuagcagggca

SEQ ID NO: 833 - RNA, 20 nt, Artificial Sequence
  Description of Artificial Sequence: Synthetic oligonucleotide
cucuugacccaacaucccaa

SEQ ID NO: 834 - RNA, 20 nt, Artificial Sequence
  Description of Artificial Sequence: Synthetic oligonucleotide
ccucuugacccaacauccca

SEQ ID NO: 835 - RNA, 20 nt, Artificial Sequence
  Description of Artificial Sequence: Synthetic oligonucleotide
uggauugacuaacacuuucc

SEQ ID NO: 836 - RNA, 20 nt, Artificial Sequence
  Description of Artificial Sequence: Synthetic oligonucleotide
guggauugacuaacacuuuc

SEQ ID NO: 837 - RNA, 20 nt, Artificial Sequence
  Description of Artificial Sequence: Synthetic oligonucleotide
cuguggcaucaaagaaaggu

SEQ ID NO: 838 - RNA, 20 nt, Artificial Sequence
  Description of Artificial Sequence: Synthetic oligonucleotide
ucugacuguggcaucaaaga

SEQ ID NO: 839 - RNA, 20 nt, Artificial Sequence
  Description of Artificial Sequence: Synthetic oligonucleotide
ucucugacuguggcaucaaa

SEQ ID NO: 840 - RNA, 20 nt, Artificial Sequence
  Description of Artificial Sequence: Synthetic oligonucleotide
ggccacccaaacuguauucu

SEQ ID NO: 841 - RNA, 20 nt, Artificial Sequence
  Description of Artificial Sequence: Synthetic oligonucleotide
accaccaagucaaaguuaga

SEQ ID NO: 842 - RNA, 20 nt, Artificial Sequence
  Description of Artificial Sequence: Synthetic oligonucleotide
caccaccaagucaaaguuag

SEQ ID NO: 843 - RNA, 20 nt, Artificial Sequence
  Description of Artificial Sequence: Synthetic oligonucleotide
guccaccaccaagucaaagu

SEQ ID NO: 844 - RNA, 20 nt, Artificial Sequence
  Description of Artificial Sequence: Synthetic oligonucleotide
gguccaccaccaagucaaag

SEQ ID NO: 845 - RNA, 20 nt, Artificial Sequence
  Description of Artificial Sequence: Synthetic oligonucleotide
aggaagguccaccaccaagu

SEQ ID NO: 846 - RNA, 20 nt, Artificial Sequence
  Description of Artificial Sequence: Synthetic oligonucleotide
aaggaagguccaccaccaag

SEQ ID NO: 847 - RNA, 20 nt, Artificial Sequence
  Description of Artificial Sequence: Synthetic oligonucleotide
caaggaagguccaccaccaa

SEQ ID NO: 848 - RNA, 20 nt, Artificial Sequence
  Description of Artificial Sequence: Synthetic oligonucleotide
ccaaggaagguccaccacca

SEQ ID NO: 849 - RNA, 20 nt, Artificial Sequence
  Description of Artificial Sequence: Synthetic oligonucleotide
accaaggaagguccaccacc

SEQ ID NO: 850 - RNA, 20 nt, Artificial Sequence
  Description of Artificial Sequence: Synthetic oligonucleotide
aaccaaggaagguccaccac

SEQ ID NO: 851 - RNA, 20 nt, Artificial Sequence
  Description of Artificial Sequence: Synthetic oligonucleotide
aaaccaaggaagguccacca

SEQ ID NO: 852 - RNA, 20 nt, Artificial Sequence
  Description of Artificial Sequence: Synthetic oligonucleotide
guugaugguacaguucuacu

SEQ ID NO: 853 - RNA, 20 nt, Artificial Sequence
  Description of Artificial Sequence: Synthetic oligonucleotide
uguugaugguacaguucuac

SEQ ID NO: 854 - RNA, 20 nt, Artificial Sequence
  Description of Artificial Sequence: Synthetic oligonucleotide
cauuguugaugguacaguuc

SEQ ID NO: 855 - RNA, 20 nt, Artificial Sequence
  Description of Artificial Sequence: Synthetic oligonucleotide
ggaaacauuguugaugguac

SEQ ID NO: 856 - RNA, 20 nt, Artificial Sequence
  Description of Artificial Sequence: Synthetic oligonucleotide
guauuggcacaguaauucuc

SEQ ID NO: 857 - RNA, 20 nt, Artificial Sequence
  Description of Artificial Sequence: Synthetic oligonucleotide
caguauuggcacaguaauuc

SEQ ID NO: 858 - RNA, 20 nt, Artificial Sequence
  Description of Artificial Sequence: Synthetic oligonucleotide
ucaaaacaguauuggcacag

SEQ ID NO: 859 - RNA, 19 nt, Artificial Sequence
  Description of Artificial Sequence: Synthetic oligonucleotide
aaagaucacagaagcugcc

SEQ ID NO: 860 - RNA, 19 nt, Artificial Sequence
  Description of Artificial Sequence: Synthetic oligonucleotide
ggcagcuucugugaucuuu

SEQ ID NO: 861 - RNA, 19 nt, Artificial Sequence
  Description of Artificial Sequence: Synthetic oligonucleotide
aagaucacagaagcugccc

SEQ ID NO: 862 - RNA, 19 nt, Artificial Sequence
  Description of Artificial Sequence: Synthetic oligonucleotide
gggcagcuucugugaucuu

SEQ ID NO: 863 - RNA, 19 nt, Artificial Sequence
  Description of Artificial Sequence: Synthetic oligonucleotide
agaucacagaagcugcccg

SEQ ID NO: 864 - RNA, 19 nt, Artificial Sequence
  Description of Artificial Sequence: Synthetic oligonucleotide
cgggcagcuucugugaucu

SEQ ID NO: 865 - RNA, 19 nt, Artificial Sequence
  Description of Artificial Sequence: Synthetic oligonucleotide
ccgggagguguuugauuaa

SEQ ID NO: 866 - RNA, 19 nt, Artificial Sequence
  Description of Artificial Sequence: Synthetic oligonucleotide
uuaaucaaacaccucccgg

SEQ ID NO: 867 - RNA, 19 nt, Artificial Sequence
  Description of Artificial Sequence: Synthetic oligonucleotide
cgggagguguuugauuaaa

SEQ ID NO: 868 - RNA, 19 nt, Artificial Sequence
  Description of Artificial Sequence: Synthetic oligonucleotide
uuuaaucaaacaccucccg

SEQ ID NO: 869 - RNA, 19 nt, Artificial Sequence
  Description of Artificial Sequence: Synthetic oligonucleotide
gggagguguuugauuaaau

SEQ ID NO: 870 - RNA, 19 nt, Artificial Sequence
  Description of Artificial Sequence: Synthetic oligonucleotide
auuuaaucaaacaccuccc

SEQ ID NO: 871 - RNA, 19 nt, Artificial Sequence
  Description of Artificial Sequence: Synthetic oligonucleotide
ggagguguuugauuaaauu

SEQ ID NO: 872 - RNA, 19 nt, Artificial Sequence
  Description of Artificial Sequence: Synthetic oligonucleotide
aauuuaaucaaacaccucc

SEQ ID NO: 873 - RNA, 19 nt, Artificial Sequence
  Description of Artificial Sequence: Synthetic oligonucleotide
gagguguuugauuaaauuc

SEQ ID NO: 874 - RNA, 19 nt, Artificial Sequence
  Description of Artificial Sequence: Synthetic oligonucleotide
gaauuuaaucaaacaccuc

SEQ ID NO: 875 - RNA, 19 nt, Artificial Sequence
  Description of Artificial Sequence: Synthetic oligonucleotide
augugacauaacuggagcc

SEQ ID NO: 876 - RNA, 19 nt, Artificial Sequence
  Description of Artificial Sequence: Synthetic oligonucleotide
ggcuccaguuaugucacau

SEQ ID NO: 877 - RNA, 19 nt, Artificial Sequence
  Description of Artificial Sequence: Synthetic oligonucleotide
ugugacauaacuggagcca

SEQ ID NO: 878 - RNA, 19 nt, Artificial Sequence
  Description of Artificial Sequence: Synthetic oligonucleotide
uggcuccaguuaugucaca

SEQ ID NO: 879 - RNA, 19 nt, Artificial Sequence
  Description of Artificial Sequence: Synthetic oligonucleotide
uggagccagugcagugcca

SEQ ID NO: 880 - RNA, 19 nt, Artificial Sequence
  Description of Artificial Sequence: Synthetic oligonucleotide
uggcacugcacuggcucca

SEQ ID NO: 881 - RNA, 19 nt, Artificial Sequence
  Description of Artificial Sequence: Synthetic oligonucleotide
gccagugcagugccaugaa

SEQ ID NO: 882 - RNA, 19 nt, Artificial Sequence
  Description of Artificial Sequence: Synthetic oligonucleotide
uucauggcacugcacuggc

SEQ ID NO: 883 - RNA, 19 nt, Artificial Sequence
  Description of Artificial Sequence: Synthetic oligonucleotide
ccagugcagugccaugaag

SEQ ID NO: 884 - RNA, 19 nt, Artificial Sequence
  Description of Artificial Sequence: Synthetic oligonucleotide
cuucauggcacugcacugg

SEQ ID NO: 885 - RNA, 19 nt, Artificial Sequence
  Description of Artificial Sequence: Synthetic oligonucleotide
cagugcagugccaugaaga

SEQ ID NO: 886 - RNA, 19 nt, Artificial Sequence
  Description of Artificial Sequence: Synthetic oligonucleotide
ucuucauggcacugcacug

SEQ ID NO: 887 - RNA, 19 nt, Artificial Sequence
  Description of Artificial Sequence: Synthetic oligonucleotide
agugcagugccaugaagaa

SEQ ID NO: 888 - RNA, 19 nt, Artificial Sequence
  Description of Artificial Sequence: Synthetic oligonucleotide
uucuucauggcacugcacu

SEQ ID NO: 889 - RNA, 19 nt, Artificial Sequence
  Description of Artificial Sequence: Synthetic oligonucleotide
agauuagccuggauauuaa

SEQ ID NO: 890 - RNA, 19 nt, Artificial Sequence
  Description of Artificial Sequence: Synthetic oligonucleotide
uuaauauccaggcuaaucu

SEQ ID NO: 891 - RNA, 19 nt, Artificial Sequence
  Description of Artificial Sequence: Synthetic oligonucleotide
gauuagccuggauauuaac

SEQ ID NO: 892 - RNA, 19 nt, Artificial Sequence
  Description of Artificial Sequence: Synthetic oligonucleotide
guuaauauccaggcuaauc

SEQ ID NO: 893 - RNA, 19 nt, Artificial Sequence
  Description of Artificial Sequence: Synthetic oligonucleotide
auuagccuggauauuaacu

SEQ ID NO: 894 - RNA, 19 nt, Artificial Sequence
  Description of Artificial Sequence: Synthetic oligonucleotide
aguuaauauccaggcuaau

SEQ ID NO: 895 - RNA, 19 nt, Artificial Sequence
  Description of Artificial Sequence: Synthetic oligonucleotide
uuagccuggauauuaacuu

SEQ ID NO: 896 - RNA, 19 nt, Artificial Sequence
  Description of Artificial Sequence: Synthetic oligonucleotide
aaguuaauauccaggcuaa

SEQ ID NO: 897 - RNA, 19 nt, Artificial Sequence
  Description of Artificial Sequence: Synthetic oligonucleotide
uagccuggauauuaacuug

SEQ ID NO: 898 - RNA, 19 nt, Artificial Sequence
  Description of Artificial Sequence: Synthetic oligonucleotide
caaguuaauauccaggcua

SEQ ID NO: 899 - RNA, 19 nt, Artificial Sequence
  Description of Artificial Sequence: Synthetic oligonucleotide
gccuggauauuaacuuguc

SEQ ID NO: 900 - RNA, 19 nt, Artificial Sequence
  Description of Artificial Sequence: Synthetic oligonucleotide
gacaaguuaauauccaggc

SEQ ID NO: 901 - RNA, 19 nt, Artificial Sequence
  Description of Artificial Sequence: Synthetic oligonucleotide
ccuggauauuaacuugucu

SEQ ID NO: 902 - RNA, 19 nt, Artificial Sequence
  Description of Artificial Sequence: Synthetic oligonucleotide
agacaaguuaauauccagg

SEQ ID NO: 903 - RNA, 19 nt, Artificial Sequence
  Description of Artificial Sequence: Synthetic oligonucleotide
cuggauauuaacuugucuu

SEQ ID NO: 904 - RNA, 19 nt, Artificial Sequence
  Description of Artificial Sequence: Synthetic oligonucleotide
aagacaaguuaauauccag

SEQ ID NO: 905 - RNA, 19 nt, Artificial Sequence
  Description of Artificial Sequence: Synthetic oligonucleotide
uggauauuaacuugucuuc

SEQ ID NO: 906 - RNA, 19 nt, Artificial Sequence
  Description of Artificial Sequence: Synthetic oligonucleotide
gaagacaaguuaauaucca

SEQ ID NO: 907 - RNA, 19 nt, Artificial Sequence
  Description of Artificial Sequence: Synthetic oligonucleotide
ggauauuaacuugucuucu

SEQ ID NO: 908 - RNA, 19 nt, Artificial Sequence
  Description of Artificial Sequence: Synthetic oligonucleotide
agaagacaaguuaauaucc

SEQ ID NO: 909 - RNA, 19 nt, Artificial Sequence
  Description of Artificial Sequence: Synthetic oligonucleotide
auuaacuugucuucuagag

SEQ ID NO: 910 - RNA, 19 nt, Artificial Sequence
  Description of Artificial Sequence: Synthetic oligonucleotide
cucuagaagacaaguuaau

SEQ ID NO: 911 - RNA, 19 nt, Artificial Sequence
  Description of Artificial Sequence: Synthetic oligonucleotide
agaauagauuucauguucc

SEQ ID NO: 912 - RNA, 19 nt, Artificial Sequence
  Description of Artificial Sequence: Synthetic oligonucleotide
ggaacaugaaaucuauucu

SEQ ID NO: 913 - RNA, 19 nt, Artificial Sequence
  Description of Artificial Sequence: Synthetic oligonucleotide
gaauagauuucauguucca

SEQ ID NO: 914 - RNA, 19 nt, Artificial Sequence
  Description of Artificial Sequence: Synthetic oligonucleotide
uggaacaugaaaucuauuc

SEQ ID NO: 915 - RNA, 19 nt, Artificial Sequence
  Description of Artificial Sequence: Synthetic oligonucleotide
uagauuucauguuccauuc

SEQ ID NO: 916 - RNA, 19 nt, Artificial Sequence
  Description of Artificial Sequence: Synthetic oligonucleotide
gaauggaacaugaaaucua

SEQ ID NO: 917 - RNA, 19 nt, Artificial Sequence
  Description of Artificial Sequence: Synthetic oligonucleotide
gauuucauguuccauucuu

SEQ ID NO: 918 - RNA, 19 nt, Artificial Sequence
  Description of Artificial Sequence: Synthetic oligonucleotide
aagaauggaacaugaaauc

SEQ ID NO: 919 - RNA, 19 nt, Artificial Sequence
  Description of Artificial Sequence: Synthetic oligonucleotide
auuucauguuccauucuuc

SEQ ID NO: 920 - RNA, 19 nt, Artificial Sequence
  Description of Artificial Sequence: Synthetic oligonucleotide
gaagaauggaacaugaaau

SEQ ID NO: 921 - RNA, 19 nt, Artificial Sequence
  Description of Artificial Sequence: Synthetic oligonucleotide
uuucauguuccauucuucu

SEQ ID NO: 922 - RNA, 19 nt, Artificial Sequence
  Description of Artificial Sequence: Synthetic oligonucleotide
agaagaauggaacaugaaa

SEQ ID NO: 923 - RNA, 19 nt, Artificial Sequence
  Description of Artificial Sequence: Synthetic oligonucleotide
uucauguuccauucuucug

SEQ ID NO: 924 - RNA, 19 nt, Artificial Sequence
  Description of Artificial Sequence: Synthetic oligonucleotide
cagaagaauggaacaugaa

SEQ ID NO: 925 - RNA, 19 nt, Artificial Sequence
  Description of Artificial Sequence: Synthetic oligonucleotide
ucauguuccauucuucugc

SEQ ID NO: 926 - RNA, 19 nt, Artificial Sequence
  Description of Artificial Sequence: Synthetic oligonucleotide
gcagaagaauggaacauga

SEQ ID NO: 927 - RNA, 19 nt, Artificial Sequence
  Description of Artificial Sequence: Synthetic oligonucleotide
cauguuccauucuucugca

SEQ ID NO: 928 - RNA, 19 nt, Artificial Sequence
  Description of Artificial Sequence: Synthetic oligonucleotide
ugcagaagaauggaacaug

SEQ ID NO: 929 - RNA, 19 nt, Artificial Sequence
  Description of Artificial Sequence: Synthetic oligonucleotide
ucuucugcaaugguuaauu

SEQ ID NO: 930 - RNA, 19 nt, Artificial Sequence
  Description of Artificial Sequence: Synthetic oligonucleotide
aauuaaccauugcagaaga

SEQ ID NO: 931 - RNA, 19 nt, Artificial Sequence
  Description of Artificial Sequence: Synthetic oligonucleotide
uucugcaaugguuaauuca

SEQ ID NO: 932 - RNA, 19 nt, Artificial Sequence
  Description of Artificial Sequence: Synthetic oligonucleotide
ugaauuaaccauugcagaa

SEQ ID NO: 933 - RNA, 19 nt, Artificial Sequence
  Description of Artificial Sequence: Synthetic oligonucleotide
cauucacagaggauuuuac

SEQ ID NO: 934 - RNA, 19 nt, Artificial Sequence
  Description of Artificial Sequence: Synthetic oligonucleotide
guaaaauccucugugaaug

SEQ ID NO: 935 - RNA, 19 nt, Artificial Sequence
  Description of Artificial Sequence: Synthetic oligonucleotide
auucacagaggauuuuacu

SEQ ID NO: 936 - RNA, 19 nt, Artificial Sequence
  Description of Artificial Sequence: Synthetic oligonucleotide
aguaaaauccucugugaau

SEQ ID NO: 937 - RNA, 19 nt, Artificial Sequence
  Description of Artificial Sequence: Synthetic oligonucleotide
acagaggauuuuacugcuu

SEQ ID NO: 938 - RNA, 19 nt, Artificial Sequence
  Description of Artificial Sequence: Synthetic oligonucleotide
aagcaguaaaauccucugu

SEQ ID NO: 939 - RNA, 19 nt, Artificial Sequence
  Description of Artificial Sequence: Synthetic oligonucleotide
cagaggauuuuacugcuua

SEQ ID NO: 940 - RNA, 19 nt, Artificial Sequence
  Description of Artificial Sequence: Synthetic oligonucleotide
uaagcaguaaaauccucug

SEQ ID NO: 941 - RNA, 19 nt, Artificial Sequence
  Description of Artificial Sequence: Synthetic oligonucleotide
agaggauuuuacugcuuaa

SEQ ID NO: 942 - RNA, 19 nt, Artificial Sequence
  Description of Artificial Sequence: Synthetic oligonucleotide
uuaagcaguaaaauccucu

SEQ ID NO: 943 - RNA, 19 nt, Artificial Sequence
  Description of Artificial Sequence: Synthetic oligonucleotide
gaggauuuuacugcuuaac

SEQ ID NO: 944 - RNA, 19 nt, Artificial Sequence
  Description of Artificial Sequence: Synthetic oligonucleotide
guuaagcaguaaaauccuc

SEQ ID NO: 945 - RNA, 19 nt, Artificial Sequence
  Description of Artificial Sequence: Synthetic oligonucleotide
auaugcauuuguucucagu

SEQ ID NO: 946 - RNA, 19 nt, Artificial Sequence
  Description of Artificial Sequence: Synthetic oligonucleotide
acugagaacaaaugcauau

SEQ ID NO: 947 - RNA, 19 nt, Artificial Sequence
  Description of Artificial Sequence: Synthetic oligonucleotide
augcauuuguucucaguuc

SEQ ID NO: 948 - RNA, 19 nt, Artificial Sequence
  Description of Artificial Sequence: Synthetic oligonucleotide
gaacugagaacaaaugcau

SEQ ID NO: 949 - RNA, 19 nt, Artificial Sequence
  Description of Artificial Sequence: Synthetic oligonucleotide
uuuguucucaguucucagu

SEQ ID NO: 950 - RNA, 19 nt, Artificial Sequence
  Description of Artificial Sequence: Synthetic oligonucleotide
acugagaacugagaacaaa

SEQ ID NO: 951 - RNA, 19 nt, Artificial Sequence
  Description of Artificial Sequence: Synthetic oligonucleotide
uuguucucaguucucagug

SEQ ID NO: 952 - RNA, 19 nt, Artificial Sequence
  Description of Artificial Sequence: Synthetic oligonucleotide
cacugagaacugagaacaa

SEQ ID NO: 953 - RNA, 19 nt, Artificial Sequence
  Description of Artificial Sequence: Synthetic oligonucleotide
guucucaguucucagugcc

SEQ ID NO: 954 - RNA, 19 nt, Artificial Sequence
  Description of Artificial Sequence: Synthetic oligonucleotide
ggcacugagaacugagaac

SEQ ID NO: 955 - RNA, 19 nt, Artificial Sequence
  Description of Artificial Sequence: Synthetic oligonucleotide
uucucaguucucagugcca

SEQ ID NO: 956 - RNA, 19 nt, Artificial Sequence
  Description of Artificial Sequence: Synthetic oligonucleotide
uggcacugagaacugagaa

SEQ ID NO: 957 - RNA, 19 nt, Artificial Sequence
  Description of Artificial Sequence: Synthetic oligonucleotide
caguucucagugccaucua

SEQ ID NO: 958 - RNA, 19 nt, Artificial Sequence
  Description of Artificial Sequence: Synthetic oligonucleotide
uagauggcacugagaacug

SEQ ID NO: 959 - RNA, 19 nt, Artificial Sequence
  Description of Artificial Sequence: Synthetic oligonucleotide
aguucucagugccaucuag

SEQ ID NO: 960 - RNA, 19 nt, Artificial Sequence
  Description of Artificial Sequence: Synthetic oligonucleotide
cuagauggcacugagaacu

SEQ ID NO: 961 - RNA, 19 nt, Artificial Sequence
  Description of Artificial Sequence: Synthetic oligonucleotide
ucagugccaucuaguuauc

SEQ ID NO: 962 - RNA, 19 nt, Artificial Sequence
  Description of Artificial Sequence: Synthetic oligonucleotide
gauaacuagauggcacuga

SEQ ID NO: 963 - RNA, 19 nt, Artificial Sequence
  Description of Artificial Sequence: Synthetic oligonucleotide
cagugccaucuaguuauca

SEQ ID NO: 964 - RNA, 19 nt, Artificial Sequence
  Description of Artificial Sequence: Synthetic oligonucleotide
ugauaacuagauggcacug

SEQ ID NO: 965 - RNA, 19 nt, Artificial Sequence
  Description of Artificial Sequence: Synthetic oligonucleotide
agugccaucuaguuaucac

SEQ ID NO: 966 - RNA, 19 nt, Artificial Sequence
  Description of Artificial Sequence: Synthetic oligonucleotide
gugauaacuagauggcacu

SEQ ID NO: 967 - RNA, 19 nt, Artificial Sequence
  Description of Artificial Sequence: Synthetic oligonucleotide
gugccaucuaguuaucacu

SEQ ID NO: 968 - RNA, 19 nt, Artificial Sequence
  Description of Artificial Sequence: Synthetic oligonucleotide
agugauaacuagauggcac

SEQ ID NO: 969 - RNA, 19 nt, Artificial Sequence
  Description of Artificial Sequence: Synthetic oligonucleotide
ugccaucuaguuaucacuu

SEQ ID NO: 970 - RNA, 19 nt, Artificial Sequence
  Description of Artificial Sequence: Synthetic oligonucleotide
aagugauaacuagauggca

SEQ ID NO: 971 - RNA, 19 nt, Artificial Sequence
  Description of Artificial Sequence: Synthetic oligonucleotide
gccaucuaguuaucacuuc

SEQ ID NO: 972 - RNA, 19 nt, Artificial Sequence
  Description of Artificial Sequence: Synthetic oligonucleotide
gaagugauaacuagauggc

SEQ ID NO: 973 - RNA, 19 nt, Artificial Sequence
  Description of Artificial Sequence: Synthetic oligonucleotide
ccaucuaguuaucacuuca

SEQ ID NO: 974 - RNA, 19 nt, Artificial Sequence
  Description of Artificial Sequence: Synthetic oligonucleotide
ugaagugauaacuagaugg

SEQ ID NO: 975 - RNA, 19 nt, Artificial Sequence
  Description of Artificial Sequence: Synthetic oligonucleotide
caucuaguuaucacuucac

SEQ ID NO: 976 - RNA, 19 nt, Artificial Sequence
  Description of Artificial Sequence: Synthetic oligonucleotide
gugaagugauaacuagaug

SEQ ID NO: 977 - RNA, 19 nt, Artificial Sequence
  Description of Artificial Sequence: Synthetic oligonucleotide
aucuaguuaucacuucacu

SEQ ID NO: 978 - RNA, 19 nt, Artificial Sequence
  Description of Artificial Sequence: Synthetic oligonucleotide
agugaagugauaacuagau

SEQ ID NO: 979 - RNA, 19 nt, Artificial Sequence
  Description of Artificial Sequence: Synthetic oligonucleotide
ucuaguuaucacuucacug

SEQ ID NO: 980 - RNA, 19 nt, Artificial Sequence
  Description of Artificial Sequence: Synthetic oligonucleotide
cagugaagugauaacuaga

SEQ ID NO: 981 - RNA, 19 nt, Artificial Sequence
  Description of Artificial Sequence: Synthetic oligonucleotide
cuaguuaucacuucacuga

SEQ ID NO: 982 - RNA, 19 nt, Artificial Sequence
  Description of Artificial Sequence: Synthetic oligonucleotide
ucagugaagugauaacuag

SEQ ID NO: 983 - RNA, 19 nt, Artificial Sequence
  Description of Artificial Sequence: Synthetic oligonucleotide
uaguuaucacuucacugag

SEQ ID NO: 984 - RNA, 19 nt, Artificial Sequence
  Description of Artificial Sequence: Synthetic oligonucleotide
cucagugaagugauaacua

SEQ ID NO: 985 - RNA, 19 nt, Artificial Sequence
  Description of Artificial Sequence: Synthetic oligonucleotide
aguuaucacuucacugagg

SEQ ID NO: 986 - RNA, 19 nt, Artificial Sequence
  Description of Artificial Sequence: Synthetic oligonucleotide
ccucagugaagugauaacu

SEQ ID NO: 987 - RNA, 19 nt, Artificial Sequence
  Description of Artificial Sequence: Synthetic oligonucleotide
guuaucacuucacugagga

SEQ ID NO: 988 - RNA, 19 nt, Artificial Sequence
  Description of Artificial Sequence: Synthetic oligonucleotide
uccucagugaagugauaac

SEQ ID NO: 989 - RNA, 19 nt, Artificial Sequence
  Description of Artificial Sequence: Synthetic oligonucleotide
uuaucacuucacugaggau

SEQ ID NO: 990 - RNA, 19 nt, Artificial Sequence
  Description of Artificial Sequence: Synthetic oligonucleotide
auccucagugaagugauaa

SEQ ID NO: 991 - RNA, 19 nt, Artificial Sequence
  Description of Artificial Sequence: Synthetic oligonucleotide
uaucacuucacugaggauc

SEQ ID NO: 992 - RNA, 19 nt, Artificial Sequence
  Description of Artificial Sequence: Synthetic oligonucleotide
gauccucagugaagugaua

SEQ ID NO: 993 - RNA, 19 nt, Artificial Sequence
  Description of Artificial Sequence: Synthetic oligonucleotide
aucacuucacugaggaucc

SEQ ID NO: 994 - RNA, 19 nt, Artificial Sequence
  Description of Artificial Sequence: Synthetic oligonucleotide
ggauccucagugaagugau

SEQ ID NO: 995 - RNA, 19 nt, Artificial Sequence
  Description of Artificial Sequence: Synthetic oligonucleotide
ucacuucacugaggauccu

SEQ ID NO: 996 - RNA, 19 nt, Artificial Sequence
  Description of Artificial Sequence: Synthetic oligonucleotide
aggauccucagugaaguga

SEQ ID NO: 997 - RNA, 19 nt, Artificial Sequence
  Description of Artificial Sequence: Synthetic oligonucleotide
gcuuucccaguagccacua

SEQ ID NO: 998 - RNA, 19 nt, Artificial Sequence
  Description of Artificial Sequence: Synthetic oligonucleotide
uaguggcuacugggaaagc

SEQ ID NO: 999 - RNA, 19 nt, Artificial Sequence
  Description of Artificial Sequence: Synthetic oligonucleotide
cuuucccaguagccacuaa

SEQ ID NO: 1000 - RNA, 19 nt, Artificial Sequence
  Description of Artificial Sequence: Synthetic oligonucleotide
uuaguggcuacugggaaag

SEQ ID NO: 1001 - RNA, 19 nt, Artificial Sequence
  Description of Artificial Sequence: Synthetic oligonucleotide
uuucccaguagccacuaau

SEQ ID NO: 1002 - RNA, 19 nt, Artificial Sequence
  Description of Artificial Sequence: Synthetic oligonucleotide
auuaguggcuacugggaaa

SEQ ID NO: 1003 - RNA, 19 nt, Artificial Sequence
  Description of Artificial Sequence: Synthetic oligonucleotide
uucccaguagccacuaaug

SEQ ID NO: 1004 - RNA, 19 nt, Artificial Sequence
  Description of Artificial Sequence: Synthetic oligonucleotide
cauuaguggcuacugggaa

SEQ ID NO: 1005 - RNA, 19 nt, Artificial Sequence
  Description of Artificial Sequence: Synthetic oligonucleotide
ucccaguagccacuaaugg

SEQ ID NO: 1006 - RNA, 19 nt, Artificial Sequence
  Description of Artificial Sequence: Synthetic oligonucleotide
ccauuaguggcuacuggga

SEQ ID NO: 1007 - RNA, 19 nt, Artificial Sequence
  Description of Artificial Sequence: Synthetic oligonucleotide
cuuggcaggagcuaaggcu

SEQ ID NO: 1008 - RNA, 19 nt, Artificial Sequence
  Description of Artificial Sequence: Synthetic oligonucleotide
agccuuagcuccugccaag

SEQ ID NO: 1009 - RNA, 19 nt, Artificial Sequence
  Description of Artificial Sequence: Synthetic oligonucleotide
ucaaaucugcagcagcaug

SEQ ID NO: 1010 - RNA, 19 nt, Artificial Sequence
  Description of Artificial Sequence: Synthetic oligonucleotide
caugcugcugcagauuuga

SEQ ID NO: 1011 - RNA, 19 nt, Artificial Sequence
  Description of Artificial Sequence: Synthetic oligonucleotide
caaaucugcagcagcauga

SEQ ID NO: 1012 - RNA, 19 nt, Artificial Sequence
  Description of Artificial Sequence: Synthetic oligonucleotide
ucaugcugcugcagauuug

SEQ ID NO: 1013 - RNA, 19 nt, Artificial Sequence
  Description of Artificial Sequence: Synthetic oligonucleotide
aaaucugcagcagcaugau

SEQ ID NO: 1014 - RNA, 19 nt, Artificial Sequence
  Description of Artificial Sequence: Synthetic oligonucleotide
aucaugcugcugcagauuu

SEQ ID NO: 1015 - RNA, 19 nt, Artificial Sequence
  Description of Artificial Sequence: Synthetic oligonucleotide
augugacauaacuggagcc

SEQ ID NO: 1016 - RNA, 19 nt, Artificial Sequence
  Description of Artificial Sequence: Synthetic oligonucleotide
ggcuccaguuaugucacau

SEQ ID NO: 1017 - RNA, 19 nt, Artificial Sequence
  Description of Artificial Sequence: Synthetic oligonucleotide
ugugacauaacuggagcca

SEQ ID NO: 1018 - RNA, 19 nt, Artificial Sequence
  Description of Artificial Sequence: Synthetic oligonucleotide
uggcuccaguuaugucaca

SEQ ID NO: 1019 - RNA, 19 nt, Artificial Sequence
  Description of Artificial Sequence: Synthetic oligonucleotide
uggagccagugcagugcca

SEQ ID NO: 1020 - RNA, 19 nt, Artificial Sequence
  Description of Artificial Sequence: Synthetic oligonucleotide
uggcacugcacuggcucca

SEQ ID NO: 1021 - RNA, 19 nt, Artificial Sequence
  Description of Artificial Sequence: Synthetic oligonucleotide
gccagugcagugccaugaa

SEQ ID NO: 1022 - RNA, 19 nt, Artificial Sequence
  Description of Artificial Sequence: Synthetic oligonucleotide
uucauggcacugcacuggc

SEQ ID NO: 1023 - RNA, 19 nt, Artificial Sequence
  Description of Artificial Sequence: Synthetic oligonucleotide
ccagugcagugccaugaag

SEQ ID NO: 1024 - RNA, 19 nt, Artificial Sequence
  Description of Artificial Sequence: Synthetic oligonucleotide
cuucauggcacugcacugg

SEQ ID NO: 1025 - RNA, 19 nt, Artificial Sequence
  Description of Artificial Sequence: Synthetic oligonucleotide
cagugcagugccaugaaga

SEQ ID NO: 1026 - RNA, 19 nt, Artificial Sequence
  Description of Artificial Sequence: Synthetic oligonucleotide
ucuucauggcacugcacug

SEQ ID NO: 1027 - RNA, 19 nt, Artificial Sequence
  Description of Artificial Sequence: Synthetic oligonucleotide
agugcagugccaugaagaa

SEQ ID NO: 1028 - RNA, 19 nt, Artificial Sequence
  Description of Artificial Sequence: Synthetic oligonucleotide
uucuucauggcacugcacu

SEQ ID NO: 1029 - RNA, 19 nt, Artificial Sequence
  Description of Artificial Sequence: Synthetic oligonucleotide
agauuagccuggauauuaa

SEQ ID NO: 1030 - RNA, 19 nt, Artificial Sequence
  Description of Artificial Sequence: Synthetic oligonucleotide
uuaauauccaggcuaaucu

SEQ ID NO: 1031 - RNA, 19 nt, Artificial Sequence
  Description of Artificial Sequence: Synthetic oligonucleotide
gauuagccuggauauuaac

SEQ ID NO: 1032 - RNA, 19 nt, Artificial Sequence
  Description of Artificial Sequence: Synthetic oligonucleotide
guuaauauccaggcuaauc

SEQ ID NO: 1033 - RNA, 19 nt, Artificial Sequence
  Description of Artificial Sequence: Synthetic oligonucleotide
auuagccuggauauuaacu

SEQ ID NO: 1034 - RNA, 19 nt, Artificial Sequence
  Description of Artificial Sequence: Synthetic oligonucleotide
aguuaauauccaggcuaau

SEQ ID NO: 1035 - RNA, 19 nt, Artificial Sequence
  Description of Artificial Sequence: Synthetic oligonucleotide
uuagccuggauauuaacuu

SEQ ID NO: 1036 - RNA, 19 nt, Artificial Sequence
  Description of Artificial Sequence: Synthetic oligonucleotide
aaguuaauauccaggcuaa

SEQ ID NO: 1037 - RNA, 19 nt, Artificial Sequence
  Description of Artificial Sequence: Synthetic oligonucleotide
uagccuggauauuaacuug

SEQ ID NO: 1038 - RNA, 19 nt, Artificial Sequence
  Description of Artificial Sequence: Synthetic oligonucleotide
caaguuaauauccaggcua

SEQ ID NO: 1039 - RNA, 19 nt, Artificial Sequence
  Description of Artificial Sequence: Synthetic oligonucleotide
gccuggauauuaacuuguc

SEQ ID NO: 1040 - RNA, 19 nt, Artificial Sequence
  Description of Artificial Sequence: Synthetic oligonucleotide
gacaaguuaauauccaggc

SEQ ID NO: 1041 - RNA, 19 nt, Artificial Sequence
  Description of Artificial Sequence: Synthetic oligonucleotide
ccuggauauuaacuugucu

SEQ ID NO: 1042 - RNA, 19 nt, Artificial Sequence
  Description of Artificial Sequence: Synthetic oligonucleotide
agacaaguuaauauccagg

SEQ ID NO: 1043 - RNA, 19 nt, Artificial Sequence
  Description of Artificial Sequence: Synthetic oligonucleotide
cuggauauuaacuugucuu

SEQ ID NO: 1044 - RNA, 19 nt, Artificial Sequence
  Description of Artificial Sequence: Synthetic oligonucleotide
aagacaaguuaauauccag

SEQ ID NO: 1045 - RNA, 19 nt, Artificial Sequence
  Description of Artificial Sequence: Synthetic oligonucleotide
uggauauuaacuugucuuc

SEQ ID NO: 1046 - RNA, 19 nt, Artificial Sequence
  Description of Artificial Sequence: Synthetic oligonucleotide
gaagacaaguuaauaucca

SEQ ID NO: 1047 - RNA, 19 nt, Artificial Sequence
  Description of Artificial Sequence: Synthetic oligonucleotide
ggauauuaacuugucuucu

SEQ ID NO: 1048 - RNA, 19 nt, Artificial Sequence
  Description of Artificial Sequence: Synthetic oligonucleotide
agaagacaaguuaauaucc

SEQ ID NO: 1049 - RNA, 19 nt, Artificial Sequence
  Description of Artificial Sequence: Synthetic oligonucleotide
auuaacuugucuucuagag

SEQ ID NO: 1050 - RNA, 19 nt, Artificial Sequence
  Description of Artificial Sequence: Synthetic oligonucleotide
cucuagaagacaaguuaau

SEQ ID NO: 1051 - RNA, 19 nt, Artificial Sequence
  Description of Artificial Sequence: Synthetic oligonucleotide
agaauagauuucauguucc

SEQ ID NO: 1052 - RNA, 19 nt, Artificial Sequence
  Description of Artificial Sequence: Synthetic oligonucleotide
ggaacaugaaaucuauucu

SEQ ID NO: 1053 - RNA, 19 nt, Artificial Sequence
  Description of Artificial Sequence: Synthetic oligonucleotide
gaauagauuucauguucca

SEQ ID NO: 1054 - RNA, 19 nt, Artificial Sequence
  Description of Artificial Sequence: Synthetic oligonucleotide
uggaacaugaaaucuauuc

SEQ ID NO: 1055 - RNA, 19 nt, Artificial Sequence
  Description of Artificial Sequence: Synthetic oligonucleotide
uagauuucauguuccauuc

SEQ ID NO: 1056 - RNA, 19 nt, Artificial Sequence
  Description of Artificial Sequence: Synthetic oligonucleotide
gaauggaacaugaaaucua

SEQ ID NO: 1057 - RNA, 19 nt, Artificial Sequence
  Description of Artificial Sequence: Synthetic oligonucleotide
gauuucauguuccauucuu

SEQ ID NO: 1058 - RNA, 19 nt, Artificial Sequence
  Description of Artificial Sequence: Synthetic oligonucleotide
aagaauggaacaugaaauc

SEQ ID NO: 1059 - RNA, 19 nt, Artificial Sequence
  Description of Artificial Sequence: Synthetic oligonucleotide
auuucauguuccauucuuc

SEQ ID NO: 1060 - RNA, 19 nt, Artificial Sequence
  Description of Artificial Sequence: Synthetic oligonucleotide
gaagaauggaacaugaaau

SEQ ID NO: 1061 - RNA, 19 nt, Artificial Sequence
  Description of Artificial Sequence: Synthetic oligonucleotide
uuucauguuccauucuucu

SEQ ID NO: 1062 - RNA, 19 nt, Artificial Sequence
  Description of Artificial Sequence: Synthetic oligonucleotide
agaagaauggaacaugaaa

SEQ ID NO: 1063 - RNA, 19 nt, Artificial Sequence
  Description of Artificial Sequence: Synthetic oligonucleotide
uucauguuccauucuucug

SEQ ID NO: 1064 - RNA, 19 nt, Artificial Sequence
  Description of Artificial Sequence: Synthetic oligonucleotide
cagaagaauggaacaugaa

SEQ ID NO: 1065 - RNA, 19 nt, Artificial Sequence
  Description of Artificial Sequence: Synthetic oligonucleotide
ucauguuccauucuucugc

SEQ ID NO: 1066 - RNA, 19 nt, Artificial Sequence
  Description of Artificial Sequence: Synthetic oligonucleotide
gcagaagaauggaacauga

SEQ ID NO: 1067 - RNA, 19 nt, Artificial Sequence
  Description of Artificial Sequence: Synthetic oligonucleotide
cauguuccauucuucugca

SEQ ID NO: 1068 - RNA, 19 nt, Artificial Sequence
  Description of Artificial Sequence: Synthetic oligonucleotide
ugcagaagaauggaacaug

SEQ ID NO: 1069 - RNA, 19 nt, Artificial Sequence
  Description of Artificial Sequence: Synthetic oligonucleotide
ucuucugcaaugguuaauu

SEQ ID NO: 1070 - RNA, 19 nt, Artificial Sequence
  Description of Artificial Sequence: Synthetic oligonucleotide
aauuaaccauugcagaaga

SEQ ID NO: 1071 - RNA, 19 nt, Artificial Sequence
  Description of Artificial Sequence: Synthetic oligonucleotide
uucugcaaugguuaauuca

SEQ ID NO: 1072 - RNA, 19 nt, Artificial Sequence
  Description of Artificial Sequence: Synthetic oligonucleotide
ugaauuaaccauugcagaa

SEQ ID NO: 1073 - RNA, 19 nt, Artificial Sequence
  Description of Artificial Sequence: Synthetic oligonucleotide
cauucacagaggauuuuac

SEQ ID NO: 1074 - RNA, 19 nt, Artificial Sequence
  Description of Artificial Sequence: Synthetic oligonucleotide
guaaaauccucugugaaug

SEQ ID NO: 1075 - RNA, 19 nt, Artificial Sequence
  Description of Artificial Sequence: Synthetic oligonucleotide
auucacagaggauuuuacu

SEQ ID NO: 1076 - RNA, 19 nt, Artificial Sequence
  Description of Artificial Sequence: Synthetic oligonucleotide
aguaaaauccucugugaau

SEQ ID NO: 1077 - RNA, 19 nt, Artificial Sequence
  Description of Artificial Sequence: Synthetic oligonucleotide
acagaggauuuuacugcuu

SEQ ID NO: 1078 - RNA, 19 nt, Artificial Sequence
  Description of Artificial Sequence: Synthetic oligonucleotide
aagcaguaaaauccucugu

SEQ ID NO: 1079 - RNA, 19 nt, Artificial Sequence
  Description of Artificial Sequence: Synthetic oligonucleotide
cagaggauuuuacugcuua

SEQ ID NO: 1080 - RNA, 19 nt, Artificial Sequence
  Description of Artificial Sequence: Synthetic oligonucleotide
uaagcaguaaaauccucug

SEQ ID NO: 1081 - RNA, 19 nt, Artificial Sequence
  Description of Artificial Sequence: Synthetic oligonucleotide
agaggauuuuacugcuuaa

SEQ ID NO: 1082 - RNA, 19 nt, Artificial Sequence
  Description of Artificial Sequence: Synthetic oligonucleotide
uuaagcaguaaaauccucu

SEQ ID NO: 1083 - RNA, 19 nt, Artificial Sequence
  Description of Artificial Sequence: Synthetic oligonucleotide
gaggauuuuacugcuuaac

SEQ ID NO: 1084 - RNA, 19 nt, Artificial Sequence
  Description of Artificial Sequence: Synthetic oligonucleotide
guuaagcaguaaaauccuc

SEQ ID NO: 1085 - RNA, 19 nt, Artificial Sequence
  Description of Artificial Sequence: Synthetic oligonucleotide
auaugcauuuguucucagu

SEQ ID NO: 1086 - RNA, 19 nt, Artificial Sequence
  Description of Artificial Sequence: Synthetic oligonucleotide
acugagaacaaaugcauau

SEQ ID NO: 1087 - RNA, 19 nt, Artificial Sequence
  Description of Artificial Sequence: Synthetic oligonucleotide
augcauuuguucucaguuc

SEQ ID NO: 1088 - RNA, 19 nt, Artificial Sequence
  Description of Artificial Sequence: Synthetic oligonucleotide
gaacugagaacaaaugcau

SEQ ID NO: 1089 - RNA, 19 nt, Artificial Sequence
  Description of Artificial Sequence: Synthetic oligonucleotide
uuuguucucaguucucagu

SEQ ID NO: 1090 - RNA, 19 nt, Artificial Sequence
  Description of Artificial Sequence: Synthetic oligonucleotide
acugagaacugagaacaaa

SEQ ID NO: 1091 - RNA, 19 nt, Artificial Sequence
  Description of Artificial Sequence: Synthetic oligonucleotide
uuguucucaguucucagug

SEQ ID NO: 1092 - RNA, 19 nt, Artificial Sequence
  Description of Artificial Sequence: Synthetic oligonucleotide
cacugagaacugagaacaa

SEQ ID NO: 1093 - RNA, 19 nt, Artificial Sequence
  Description of Artificial Sequence: Synthetic oligonucleotide
guucucaguucucagugcc

SEQ ID NO: 1094 - RNA, 19 nt, Artificial Sequence
  Description of Artificial Sequence: Synthetic oligonucleotide
ggcacugagaacugagaac

SEQ ID NO: 1095 - RNA, 19 nt, Artificial Sequence
  Description of Artificial Sequence: Synthetic oligonucleotide
uucucaguucucagugcca

SEQ ID NO: 1096 - RNA, 19 nt, Artificial Sequence
  Description of Artificial Sequence: Synthetic oligonucleotide
uggcacugagaacugagaa

SEQ ID NO: 1097 - RNA, 19 nt, Artificial Sequence
  Description of Artificial Sequence: Synthetic oligonucleotide
caguucucagugccaucua

SEQ ID NO: 1098 - RNA, 19 nt, Artificial Sequence
  Description of Artificial Sequence: Synthetic oligonucleotide
uagauggcacugagaacug

SEQ ID NO: 1099 - RNA, 19 nt, Artificial Sequence
  Description of Artificial Sequence: Synthetic oligonucleotide
aguucucagugccaucuag

SEQ ID NO: 1100 - RNA, 19 nt, Artificial Sequence
  Description of Artificial Sequence: Synthetic oligonucleotide
cuagauggcacugagaacu

SEQ ID NO: 1101 - RNA, 19 nt, Artificial Sequence
  Description of Artificial Sequence: Synthetic oligonucleotide
ucagugccaucuaguuauc

SEQ ID NO: 1102 - RNA, 19 nt, Artificial Sequence
  Description of Artificial Sequence: Synthetic oligonucleotide
gauaacuagauggcacuga

SEQ ID NO: 1103 - RNA, 19 nt, Artificial Sequence
  Description of Artificial Sequence: Synthetic oligonucleotide
cagugccaucuaguuauca

SEQ ID NO: 1104 - RNA, 19 nt, Artificial Sequence
  Description of Artificial Sequence: Synthetic oligonucleotide
ugauaacuagauggcacug

SEQ ID NO: 1105 - RNA, 19 nt, Artificial Sequence
  Description of Artificial Sequence: Synthetic oligonucleotide
agugccaucuaguuaucac

SEQ ID NO: 1106 - RNA, 19 nt, Artificial Sequence
  Description of Artificial Sequence: Synthetic oligonucleotide
gugauaacuagauggcacu

SEQ ID NO: 1107 - RNA, 19 nt, Artificial Sequence
  Description of Artificial Sequence: Synthetic oligonucleotide
gugccaucuaguuaucacu

SEQ ID NO: 1108 - RNA, 19 nt, Artificial Sequence
  Description of Artificial Sequence: Synthetic oligonucleotide
agugauaacuagauggcac

SEQ ID NO: 1109 - RNA, 19 nt, Artificial Sequence
  Description of Artificial Sequence: Synthetic oligonucleotide
ugccaucuaguuaucacuu

SEQ ID NO: 1110 - RNA, 19 nt, Artificial Sequence
  Description of Artificial Sequence: Synthetic oligonucleotide
aagugauaacuagauggca

SEQ ID NO: 1111 - RNA, 19 nt, Artificial Sequence
  Description of Artificial Sequence: Synthetic oligonucleotide
gccaucuaguuaucacuuc

SEQ ID NO: 1112 - RNA, 19 nt, Artificial Sequence
  Description of Artificial Sequence: Synthetic oligonucleotide
gaagugauaacuagauggc

SEQ ID NO: 1113 - RNA, 19 nt, Artificial Sequence
  Description of Artificial Sequence: Synthetic oligonucleotide
ccaucuaguuaucacuuca

SEQ ID NO: 1114 - RNA, 19 nt, Artificial Sequence
  Description of Artificial Sequence: Synthetic oligonucleotide
ugaagugauaacuagaugg

SEQ ID NO: 1115 - RNA, 19 nt, Artificial Sequence
  Description of Artificial Sequence: Synthetic oligonucleotide
caucuaguuaucacuucac

SEQ ID NO: 1116 - RNA, 19 nt, Artificial Sequence
  Description of Artificial Sequence: Synthetic oligonucleotide
gugaagugauaacuagaug

SEQ ID NO: 1117 - RNA, 19 nt, Artificial Sequence
  Description of Artificial Sequence: Synthetic oligonucleotide
aucuaguuaucacuucacu

SEQ ID NO: 1118 - RNA, 19 nt, Artificial Sequence
  Description of Artificial Sequence: Synthetic oligonucleotide
agugaagugauaacuagau

SEQ ID NO: 1119 - RNA, 19 nt, Artificial Sequence
  Description of Artificial Sequence: Synthetic oligonucleotide
ucuaguuaucacuucacug

SEQ ID NO: 1120 - RNA, 19 nt, Artificial Sequence
  Description of Artificial Sequence: Synthetic oligonucleotide
cagugaagugauaacuaga

SEQ ID NO: 1121 - RNA, 19 nt, Artificial Sequence
  Description of Artificial Sequence: Synthetic oligonucleotide
cuaguuaucacuucacuga

SEQ ID NO: 1122 - RNA, 19 nt, Artificial Sequence
  Description of Artificial Sequence: Synthetic oligonucleotide
ucagugaagugauaacuag

SEQ ID NO: 1123 - RNA, 19 nt, Artificial Sequence
  Description of Artificial Sequence: Synthetic oligonucleotide
uaguuaucacuucacugag

SEQ ID NO: 1124 - RNA, 19 nt, Artificial Sequence
  Description of Artificial Sequence: Synthetic oligonucleotide
cucagugaagugauaacua

SEQ ID NO: 1125 - RNA, 19 nt, Artificial Sequence
  Description of Artificial Sequence: Synthetic oligonucleotide
aguuaucacuucacugagg

SEQ ID NO: 1126 - RNA, 19 nt, Artificial Sequence
  Description of Artificial Sequence: Synthetic oligonucleotide
ccucagugaagugauaacu

SEQ ID NO: 1127 - RNA, 19 nt, Artificial Sequence
  Description of Artificial Sequence: Synthetic oligonucleotide
guuaucacuucacugagga

SEQ ID NO: 1128 - RNA, 19 nt, Artificial Sequence
  Description of Artificial Sequence: Synthetic oligonucleotide
uccucagugaagugauaac

SEQ ID NO: 1129 - RNA, 19 nt, Artificial Sequence
  Description of Artificial Sequence: Synthetic oligonucleotide
uuaucacuucacugaggau

SEQ ID NO: 1130 - RNA, 19 nt, Artificial Sequence
  Description of Artificial Sequence: Synthetic oligonucleotide
auccucagugaagugauaa

SEQ ID NO: 1131 - RNA, 19 nt, Artificial Sequence
  Description of Artificial Sequence: Synthetic oligonucleotide
uaucacuucacugaggauc

SEQ ID NO: 1132 - RNA, 19 nt, Artificial Sequence
  Description of Artificial Sequence: Synthetic oligonucleotide
gauccucagugaagugaua

SEQ ID NO: 1133 - RNA, 19 nt, Artificial Sequence
  Description of Artificial Sequence: Synthetic oligonucleotide
aucacuucacugaggaucc

SEQ ID NO: 1134 - RNA, 19 nt, Artificial Sequence
  Description of Artificial Sequence: Synthetic oligonucleotide
ggauccucagugaagugau

SEQ ID NO: 1135 - RNA, 19 nt, Artificial Sequence
  Description of Artificial Sequence: Synthetic oligonucleotide
ucacuucacugaggauccu

SEQ ID NO: 1136 - RNA, 19 nt, Artificial Sequence
  Description of Artificial Sequence: Synthetic oligonucleotide
aggauccucagugaaguga

SEQ ID NO: 1137 - RNA, 19 nt, Artificial Sequence
  Description of Artificial Sequence: Synthetic oligonucleotide
gcuuucccaguagccacua

SEQ ID NO: 1138 - RNA, 19 nt, Artificial Sequence
  Description of Artificial Sequence: Synthetic oligonucleotide
uaguggcuacugggaaagc

SEQ ID NO: 1139 - RNA, 19 nt, Artificial Sequence
  Description of Artificial Sequence: Synthetic oligonucleotide
cuuucccaguagccacuaa

SEQ ID NO: 1140 - RNA, 19 nt, Artificial Sequence
  Description of Artificial Sequence: Synthetic oligonucleotide
uuaguggcuacugggaaag

SEQ ID NO: 1141 - RNA, 19 nt, Artificial Sequence
  Description of Artificial Sequence: Synthetic oligonucleotide
uuucccaguagccacuaau

SEQ ID NO: 1142 - RNA, 19 nt, Artificial Sequence
  Description of Artificial Sequence: Synthetic oligonucleotide
auuaguggcuacugggaaa

SEQ ID NO: 1143 - RNA, 19 nt, Artificial Sequence
  Description of Artificial Sequence: Synthetic oligonucleotide
uucccaguagccacuaaug

SEQ ID NO: 1144 - RNA, 19 nt, Artificial Sequence
  Description of Artificial Sequence: Synthetic oligonucleotide
cauuaguggcuacugggaa

SEQ ID NO: 1145 - RNA, 19 nt, Artificial Sequence
  Description of Artificial Sequence: Synthetic oligonucleotide
ucccaguagccacuaaugg

SEQ ID NO: 1146 - RNA, 19 nt, Artificial Sequence
  Description of Artificial Sequence: Synthetic oligonucleotide
ccauuaguggcuacuggga

SEQ ID NO: 1147 - RNA, 19 nt, Artificial Sequence
  Description of Artificial Sequence: Synthetic oligonucleotide
cuuggcaggagcuaaggcu

SEQ ID NO: 1148 - RNA, 19 nt, Artificial Sequence
  Description of Artificial Sequence: Synthetic oligonucleotide
agccuuagcuccugccaag

SEQ ID NO: 1149 - RNA, 19 nt, Artificial Sequence
  Description of Artificial Sequence: Synthetic oligonucleotide
ccaguguggucauuccucu

SEQ ID NO: 1150 - RNA, 19 nt, Artificial Sequence
  Description of Artificial Sequence: Synthetic oligonucleotide
agaggaaugaccacacugg

SEQ ID NO: 1151 - RNA, 19 nt, Artificial Sequence
  Description of Artificial Sequence: Synthetic oligonucleotide
gucauuccucuccauuaug

SEQ ID NO: 1152 - RNA, 19 nt, Artificial Sequence
  Description of Artificial Sequence: Synthetic oligonucleotide
cauaauggagaggaaugac

SEQ ID NO: 1153 - RNA, 19 nt, Artificial Sequence
  Description of Artificial Sequence: Synthetic oligonucleotide
cauuccucuccauuaugac

SEQ ID NO: 1154 - RNA, 19 nt, Artificial Sequence
  Description of Artificial Sequence: Synthetic oligonucleotide
gucauaauggagaggaaug

SEQ ID NO: 1155 - RNA, 19 nt, Artificial Sequence
  Description of Artificial Sequence: Synthetic oligonucleotide
auuccucuccauuaugacc

SEQ ID NO: 1156 - RNA, 19 nt, Artificial Sequence
  Description of Artificial Sequence: Synthetic oligonucleotide
ggucauaauggagaggaau

SEQ ID NO: 1157 - RNA, 19 nt, Artificial Sequence
  Description of Artificial Sequence: Synthetic oligonucleotide
cucuccauuaugaccucuu

SEQ ID NO: 1158 - RNA, 19 nt, Artificial Sequence
  Description of Artificial Sequence: Synthetic oligonucleotide
aagaggucauaauggagag

SEQ ID NO: 1159 - RNA, 19 nt, Artificial Sequence
  Description of Artificial Sequence: Synthetic oligonucleotide
ucuccauuaugaccucuuu

SEQ ID NO: 1160 - RNA, 19 nt, Artificial Sequence
  Description of Artificial Sequence: Synthetic oligonucleotide
aaagaggucauaauggaga

SEQ ID NO: 1161 - RNA, 19 nt, Artificial Sequence
  Description of Artificial Sequence: Synthetic oligonucleotide
cuccauuaugaccucuuug

SEQ ID NO: 1162 - RNA, 19 nt, Artificial Sequence
  Description of Artificial Sequence: Synthetic oligonucleotide
caaagaggucauaauggag

SEQ ID NO: 1163 - RNA, 19 nt, Artificial Sequence
  Description of Artificial Sequence: Synthetic oligonucleotide
uccauuaugaccucuuugu

SEQ ID NO: 1164 - RNA, 19 nt, Artificial Sequence
  Description of Artificial Sequence: Synthetic oligonucleotide
acaaagaggucauaaugga

SEQ ID NO: 1165 - RNA, 19 nt, Artificial Sequence
  Description of Artificial Sequence: Synthetic oligonucleotide
ccauuaugaccucuuuguc

SEQ ID NO: 1166 - RNA, 19 nt, Artificial Sequence
  Description of Artificial Sequence: Synthetic oligonucleotide
gacaaagaggucauaaugg

SEQ ID NO: 1167 - RNA, 19 nt, Artificial Sequence
  Description of Artificial Sequence: Synthetic oligonucleotide
cauuaugaccucuuugucc

SEQ ID NO: 1168 - RNA, 19 nt, Artificial Sequence
  Description of Artificial Sequence: Synthetic oligonucleotide
ggacaaagaggucauaaug

SEQ ID NO: 1169 - RNA, 19 nt, Artificial Sequence
  Description of Artificial Sequence: Synthetic oligonucleotide
cccaaucucaccucucugg

SEQ ID NO: 1170 - RNA, 19 nt, Artificial Sequence
  Description of Artificial Sequence: Synthetic oligonucleotide
ccagagaggugagauuggg

SEQ ID NO: 1171 - RNA, 19 nt, Artificial Sequence
  Description of Artificial Sequence: Synthetic oligonucleotide
ucucaccucucuggacuuu

SEQ ID NO: 1172 - RNA, 19 nt, Artificial Sequence
  Description of Artificial Sequence: Synthetic oligonucleotide
aaaguccagagaggugaga

SEQ ID NO: 1173 - RNA, 19 nt, Artificial Sequence
  Description of Artificial Sequence: Synthetic oligonucleotide
cucaccucucuggacuuug

SEQ ID NO: 1174 - RNA, 19 nt, Artificial Sequence
  Description of Artificial Sequence: Synthetic oligonucleotide
caaaguccagagaggugag

SEQ ID NO: 1175 - RNA, 19 nt, Artificial Sequence
  Description of Artificial Sequence: Synthetic oligonucleotide
ucaccucucuggacuuugu

SEQ ID NO: 1176 - RNA, 19 nt, Artificial Sequence
  Description of Artificial Sequence: Synthetic oligonucleotide
acaaaguccagagagguga

SEQ ID NO: 1177 - RNA, 19 nt, Artificial Sequence
  Description of Artificial Sequence: Synthetic oligonucleotide
ucucuggacuuuguugcau

SEQ ID NO: 1178 - RNA, 19 nt, Artificial Sequence
  Description of Artificial Sequence: Synthetic oligonucleotide
augcaacaaaguccagaga

SEQ ID NO: 1179 - RNA, 19 nt, Artificial Sequence
  Description of Artificial Sequence: Synthetic oligonucleotide
cucuggacuuuguugcauc

SEQ ID NO: 1180 - RNA, 19 nt, Artificial Sequence
  Description of Artificial Sequence: Synthetic oligonucleotide
gaugcaacaaaguccagag

SEQ ID NO: 1181 - RNA, 19 nt, Artificial Sequence
  Description of Artificial Sequence: Synthetic oligonucleotide
cuggacuuuguugcaucug

SEQ ID NO: 1182 - RNA, 19 nt, Artificial Sequence
  Description of Artificial Sequence: Synthetic oligonucleotide
cagaugcaacaaaguccag

SEQ ID NO: 1183 - RNA, 19 nt, Artificial Sequence
  Description of Artificial Sequence: Synthetic oligonucleotide
ggacuuuguugcaucugag

SEQ ID NO: 1184 - RNA, 19 nt, Artificial Sequence
  Description of Artificial Sequence: Synthetic oligonucleotide
cucagaugcaacaaagucc

SEQ ID NO: 1185 - RNA, 19 nt, Artificial Sequence
  Description of Artificial Sequence: Synthetic oligonucleotide
gaagucuuggucagcaaug

SEQ ID NO: 1186 - RNA, 19 nt, Artificial Sequence
  Description of Artificial Sequence: Synthetic oligonucleotide
cauugcugaccaagacuuc

SEQ ID NO: 1187 - RNA, 19 nt, Artificial Sequence
  Description of Artificial Sequence: Synthetic oligonucleotide
aagucuuggucagcaaugc

SEQ ID NO: 1188 - RNA, 19 nt, Artificial Sequence
  Description of Artificial Sequence: Synthetic oligonucleotide
gcauugcugaccaagacuu

SEQ ID NO: 1189 - RNA, 19 nt, Artificial Sequence
  Description of Artificial Sequence: Synthetic oligonucleotide
agucuuggucagcaaugcu

SEQ ID NO: 1190 - RNA, 19 nt, Artificial Sequence
  Description of Artificial Sequence: Synthetic oligonucleotide
agcauugcugaccaagacu

SEQ ID NO: 1191 - RNA, 19 nt, Artificial Sequence
  Description of Artificial Sequence: Synthetic oligonucleotide
gucuuggucagcaaugcua

SEQ ID NO: 1192 - RNA, 19 nt, Artificial Sequence
  Description of Artificial Sequence: Synthetic oligonucleotide
uagcauugcugaccaagac

SEQ ID NO: 1193 - RNA, 19 nt, Artificial Sequence
  Description of Artificial Sequence: Synthetic oligonucleotide
ucuuggucagcaaugcuac

SEQ ID NO: 1194 - RNA, 19 nt, Artificial Sequence
  Description of Artificial Sequence: Synthetic oligonucleotide
guagcauugcugaccaaga

SEQ ID NO: 1195 - RNA, 19 nt, Artificial Sequence
  Description of Artificial Sequence: Synthetic oligonucleotide
cuuggucagcaaugcuacc

SEQ ID NO: 1196 - RNA, 19 nt, Artificial Sequence
  Description of Artificial Sequence: Synthetic oligonucleotide
gguagcauugcugaccaag

SEQ ID NO: 1197 - RNA, 19 nt, Artificial Sequence
  Description of Artificial Sequence: Synthetic oligonucleotide
uuggucagcaaugcuaccc

SEQ ID NO: 1198 - RNA, 19 nt, Artificial Sequence
  Description of Artificial Sequence: Synthetic oligonucleotide
ggguagcauugcugaccaa

SEQ ID NO: 1199 - RNA, 19 nt, Artificial Sequence
  Description of Artificial Sequence: Synthetic oligonucleotide
uggucagcaaugcuaccca

SEQ ID NO: 1200 - RNA, 19 nt, Artificial Sequence
  Description of Artificial Sequence: Synthetic oligonucleotide
uggguagcauugcugacca

SEQ ID NO: 1201 - RNA, 19 nt, Artificial Sequence
  Description of Artificial Sequence: Synthetic oligonucleotide
ggucagcaaugcuacccag

SEQ ID NO: 1202 - RNA, 19 nt, Artificial Sequence
  Description of Artificial Sequence: Synthetic oligonucleotide
cuggguagcauugcugacc

SEQ ID NO: 1203 - RNA, 19 nt, Artificial Sequence
  Description of Artificial Sequence: Synthetic oligonucleotide
gucagcaaugcuacccagu

SEQ ID NO: 1204 - RNA, 19 nt, Artificial Sequence
  Description of Artificial Sequence: Synthetic oligonucleotide
acuggguagcauugcugac

SEQ ID NO: 1205 - RNA, 19 nt, Artificial Sequence
  Description of Artificial Sequence: Synthetic oligonucleotide
ucagcaaugcuacccaguu

SEQ ID NO: 1206 - RNA, 19 nt, Artificial Sequence
  Description of Artificial Sequence: Synthetic oligonucleotide
aacuggguagcauugcuga

SEQ ID NO: 1207 - RNA, 19 nt, Artificial Sequence
  Description of Artificial Sequence: Synthetic oligonucleotide
cagcaaugcuacccaguuu

SEQ ID NO: 1208 - RNA, 19 nt, Artificial Sequence
  Description of Artificial Sequence: Synthetic oligonucleotide
aaacuggguagcauugcug

SEQ ID NO: 1209 - RNA, 19 nt, Artificial Sequence
  Description of Artificial Sequence: Synthetic oligonucleotide
agcaaugcuacccaguuua

SEQ ID NO: 1210 - RNA, 19 nt, Artificial Sequence
  Description of Artificial Sequence: Synthetic oligonucleotide
uaaacuggguagcauugcu

SEQ ID NO: 1211 - RNA, 19 nt, Artificial Sequence
  Description of Artificial Sequence: Synthetic oligonucleotide
caaugcuacccaguuuauc

SEQ ID NO: 1212 - RNA, 19 nt, Artificial Sequence
  Description of Artificial Sequence: Synthetic oligonucleotide
gauaaacuggguagcauug

SEQ ID NO: 1213 - RNA, 19 nt, Artificial Sequence
  Description of Artificial Sequence: Synthetic oligonucleotide
aaugcuacccaguuuauca

SEQ ID NO: 1214 - RNA, 19 nt, Artificial Sequence
  Description of Artificial Sequence: Synthetic oligonucleotide
ugauaaacuggguagcauu

SEQ ID NO: 1215 - RNA, 19 nt, Artificial Sequence
  Description of Artificial Sequence: Synthetic oligonucleotide
augcuacccaguuuaucau

SEQ ID NO: 1216 - RNA, 19 nt, Artificial Sequence
  Description of Artificial Sequence: Synthetic oligonucleotide
augauaaacuggguagcau

SEQ ID NO: 1217 - RNA, 19 nt, Artificial Sequence
  Description of Artificial Sequence: Synthetic oligonucleotide
ugcuacccaguuuaucauc

SEQ ID NO: 1218 - RNA, 19 nt, Artificial Sequence
  Description of Artificial Sequence: Synthetic oligonucleotide
gaugauaaacuggguagca

SEQ ID NO: 1219 - RNA, 19 nt, Artificial Sequence
  Description of Artificial Sequence: Synthetic oligonucleotide
gcuacccaguuuaucaucu

SEQ ID NO: 1220 - RNA, 19 nt, Artificial Sequence
  Description of Artificial Sequence: Synthetic oligonucleotide
agaugauaaacuggguagc

SEQ ID NO: 1221 - RNA, 19 nt, Artificial Sequence
  Description of Artificial Sequence: Synthetic oligonucleotide
cuacccaguuuaucaucuu

SEQ ID NO: 1222 - RNA, 19 nt, Artificial Sequence
  Description of Artificial Sequence: Synthetic oligonucleotide
aagaugauaaacuggguag

SEQ ID NO: 1223 - RNA, 19 nt, Artificial Sequence
  Description of Artificial Sequence: Synthetic oligonucleotide
uacccaguuuaucaucuug

SEQ ID NO: 1224 - RNA, 19 nt, Artificial Sequence
  Description of Artificial Sequence: Synthetic oligonucleotide
caagaugauaaacugggua

SEQ ID NO: 1225 - RNA, 19 nt, Artificial Sequence
  Description of Artificial Sequence: Synthetic oligonucleotide
acccaguuuaucaucuugc

SEQ ID NO: 1226 - RNA, 19 nt, Artificial Sequence
  Description of Artificial Sequence: Synthetic oligonucleotide
gcaagaugauaaacugggu

SEQ ID NO: 1227 - RNA, 19 nt, Artificial Sequence
  Description of Artificial Sequence: Synthetic oligonucleotide
cccaguuuaucaucuugca

SEQ ID NO: 1228 - RNA, 19 nt, Artificial Sequence
  Description of Artificial Sequence: Synthetic oligonucleotide
ugcaagaugauaaacuggg

SEQ ID NO: 1229 - RNA, 19 nt, Artificial Sequence
  Description of Artificial Sequence: Synthetic oligonucleotide
guuuaucaucuugcacagc

SEQ ID NO: 1230 - RNA, 19 nt, Artificial Sequence
  Description of Artificial Sequence: Synthetic oligonucleotide
gcugugcaagaugauaaac

SEQ ID NO: 1231 - RNA, 19 nt, Artificial Sequence
  Description of Artificial Sequence: Synthetic oligonucleotide
uuuaucaucuugcacagca

SEQ ID NO: 1232 - RNA, 19 nt, Artificial Sequence
  Description of Artificial Sequence: Synthetic oligonucleotide
ugcugugcaagaugauaaa

SEQ ID NO: 1233 - RNA, 19 nt, Artificial Sequence
  Description of Artificial Sequence: Synthetic oligonucleotide
ucacgaaugccacccuuca

SEQ ID NO: 1234 - RNA, 19 nt, Artificial Sequence
  Description of Artificial Sequence: Synthetic oligonucleotide
ugaaggguggcauucguga

SEQ ID NO: 1235 - RNA, 19 nt, Artificial Sequence
  Description of Artificial Sequence: Synthetic oligonucleotide
cacgaaugccacccuucag

SEQ ID NO: 1236 - RNA, 19 nt, Artificial Sequence
  Description of Artificial Sequence: Synthetic oligonucleotide
cugaaggguggcauucgug

SEQ ID NO: 1237 - RNA, 19 nt, Artificial Sequence
  Description of Artificial Sequence: Synthetic oligonucleotide
acgaaugccacccuucagu

SEQ ID NO: 1238 - RNA, 19 nt, Artificial Sequence
  Description of Artificial Sequence: Synthetic oligonucleotide
acugaaggguggcauucgu

SEQ ID NO: 1239 - RNA, 19 nt, Artificial Sequence
  Description of Artificial Sequence: Synthetic oligonucleotide
cgaaugccacccuucaguc

SEQ ID NO: 1240 - RNA, 19 nt, Artificial Sequence
  Description of Artificial Sequence: Synthetic oligonucleotide
gacugaaggguggcauucg

SEQ ID NO: 1241 - RNA, 19 nt, Artificial Sequence
  Description of Artificial Sequence: Synthetic oligonucleotide
gaaugccacccuucaguca

SEQ ID NO: 1242 - RNA, 19 nt, Artificial Sequence
  Description of Artificial Sequence: Synthetic oligonucleotide
ugacugaaggguggcauuc

SEQ ID NO: 1243 - RNA, 19 nt, Artificial Sequence
  Description of Artificial Sequence: Synthetic oligonucleotide
uucagucagaggaagauuc

SEQ ID NO: 1244 - RNA, 19 nt, Artificial Sequence
  Description of Artificial Sequence: Synthetic oligonucleotide
gaaucuuccucugacugaa

SEQ ID NO: 1245 - RNA, 19 nt, Artificial Sequence
  Description of Artificial Sequence: Synthetic oligonucleotide
ucagucagaggaagauuca

SEQ ID NO: 1246 - RNA, 19 nt, Artificial Sequence
  Description of Artificial Sequence: Synthetic oligonucleotide
ugaaucuuccucugacuga

SEQ ID NO: 1247 - RNA, 19 nt, Artificial Sequence
  Description of Artificial Sequence: Synthetic oligonucleotide
cagucagaggaagauucaa

SEQ ID NO: 1248 - RNA, 19 nt, Artificial Sequence
  Description of Artificial Sequence: Synthetic oligonucleotide
uugaaucuuccucugacug

SEQ ID NO: 1249 - RNA, 19 nt, Artificial Sequence
  Description of Artificial Sequence: Synthetic oligonucleotide
agucagaggaagauucaag

SEQ ID NO: 1250 - RNA, 19 nt, Artificial Sequence
  Description of Artificial Sequence: Synthetic oligonucleotide
cuugaaucuuccucugacu

SEQ ID NO: 1251 - RNA, 19 nt, Artificial Sequence
  Description of Artificial Sequence: Synthetic oligonucleotide
gucagaggaagauucaaga

SEQ ID NO: 1252 - RNA, 19 nt, Artificial Sequence
  Description of Artificial Sequence: Synthetic oligonucleotide
ucuugaaucuuccucugac

SEQ ID NO: 1253 - RNA, 19 nt, Artificial Sequence
  Description of Artificial Sequence: Synthetic oligonucleotide
cagaggaagauucaagaua

SEQ ID NO: 1254 - RNA, 19 nt, Artificial Sequence
  Description of Artificial Sequence: Synthetic oligonucleotide
uaucuugaaucuuccucug

SEQ ID NO: 1255 - RNA, 19 nt, Artificial Sequence
  Description of Artificial Sequence: Synthetic oligonucleotide
agaggaagauucaagauac

SEQ ID NO: 1256 - RNA, 19 nt, Artificial Sequence
  Description of Artificial Sequence: Synthetic oligonucleotide
guaucuugaaucuuccucu

SEQ ID NO: 1257 - RNA, 19 nt, Artificial Sequence
  Description of Artificial Sequence: Synthetic oligonucleotide
gaggaagauucaagauaca

SEQ ID NO: 1258 - RNA, 19 nt, Artificial Sequence
  Description of Artificial Sequence: Synthetic oligonucleotide
uguaucuugaaucuuccuc

SEQ ID NO: 1259 - RNA, 19 nt, Artificial Sequence
  Description of Artificial Sequence: Synthetic oligonucleotide
aggaagauucaagauacau

SEQ ID NO: 1260 - RNA, 19 nt, Artificial Sequence
  Description of Artificial Sequence: Synthetic oligonucleotide
auguaucuugaaucuuccu

SEQ ID NO: 1261 - RNA, 19 nt, Artificial Sequence
  Description of Artificial Sequence: Synthetic oligonucleotide
ggaagauucaagauacaug

SEQ ID NO: 1262 - RNA, 19 nt, Artificial Sequence
  Description of Artificial Sequence: Synthetic oligonucleotide
cauguaucuugaaucuucc

SEQ ID NO: 1263 - RNA, 19 nt, Artificial Sequence
  Description of Artificial Sequence: Synthetic oligonucleotide
gaagauucaagauacauga

SEQ ID NO: 1264 - RNA, 19 nt, Artificial Sequence
  Description of Artificial Sequence: Synthetic oligonucleotide
ucauguaucuugaaucuuc

SEQ ID NO: 1265 - RNA, 19 nt, Artificial Sequence
  Description of Artificial Sequence: Synthetic oligonucleotide
aaaguuuugaguuacccug

SEQ ID NO: 1266 - RNA, 19 nt, Artificial Sequence
  Description of Artificial Sequence: Synthetic oligonucleotide
caggguaacucaaaacuuu

SEQ ID NO: 1267 - RNA, 19 nt, Artificial Sequence
  Description of Artificial Sequence: Synthetic oligonucleotide
caaauugcacugcugguuc

SEQ ID NO: 1268 - RNA, 19 nt, Artificial Sequence
  Description of Artificial Sequence: Synthetic oligonucleotide
gaaccagcagugcaauuug

SEQ ID NO: 1269 - RNA, 19 nt, Artificial Sequence
  Description of Artificial Sequence: Synthetic oligonucleotide
aaauugcacugcugguucc

SEQ ID NO: 1270 - RNA, 19 nt, Artificial Sequence
  Description of Artificial Sequence: Synthetic oligonucleotide
ggaaccagcagugcaauuu

SEQ ID NO: 1271 - RNA, 19 nt, Artificial Sequence
  Description of Artificial Sequence: Synthetic oligonucleotide
aauugcacugcugguucca

SEQ ID NO: 1272 - RNA, 19 nt, Artificial Sequence
  Description of Artificial Sequence: Synthetic oligonucleotide
uggaaccagcagugcaauu

SEQ ID NO: 1273 - RNA, 19 nt, Artificial Sequence
  Description of Artificial Sequence: Synthetic oligonucleotide
auugcacugcugguuccag

SEQ ID NO: 1274 - RNA, 19 nt, Artificial Sequence
  Description of Artificial Sequence: Synthetic oligonucleotide
cuggaaccagcagugcaau

SEQ ID NO: 1275 - RNA, 19 nt, Artificial Sequence
  Description of Artificial Sequence: Synthetic oligonucleotide
uugcacugcugguuccaga

SEQ ID NO: 1276 - RNA, 19 nt, Artificial Sequence
  Description of Artificial Sequence: Synthetic oligonucleotide
ucuggaaccagcagugcaa

SEQ ID NO: 1277 - RNA, 19 nt, Artificial Sequence
  Description of Artificial Sequence: Synthetic oligonucleotide
aaauacuauguggcuaugg

SEQ ID NO: 1278 - RNA, 19 nt, Artificial Sequence
  Description of Artificial Sequence: Synthetic oligonucleotide
ccauagccacauaguauuu

SEQ ID NO: 1279 - RNA, 19 nt, Artificial Sequence
  Description of Artificial Sequence: Synthetic oligonucleotide
aauacuauguggcuaugga

SEQ ID NO: 1280 - RNA, 19 nt, Artificial Sequence
  Description of Artificial Sequence: Synthetic oligonucleotide
uccauagccacauaguauu

SEQ ID NO: 1281 - RNA, 19 nt, Artificial Sequence
  Description of Artificial Sequence: Synthetic oligonucleotide
auacuauguggcuauggac

SEQ ID NO: 1282 - RNA, 19 nt, Artificial Sequence
  Description of Artificial Sequence: Synthetic oligonucleotide
guccauagccacauaguau

SEQ ID NO: 1283 - RNA, 19 nt, Artificial Sequence
  Description of Artificial Sequence: Synthetic oligonucleotide
uacuauguggcuauggacu

SEQ ID NO: 1284 - RNA, 19 nt, Artificial Sequence
  Description of Artificial Sequence: Synthetic oligonucleotide
aguccauagccacauagua

SEQ ID NO: 1285 - RNA, 19 nt, Artificial Sequence
  Description of Artificial Sequence: Synthetic oligonucleotide
acuauguggcuauggacuu

SEQ ID NO: 1286 - RNA, 19 nt, Artificial Sequence
  Description of Artificial Sequence: Synthetic oligonucleotide
aaguccauagccacauagu

SEQ ID NO: 1287 - RNA, 19 nt, Artificial Sequence
  Description of Artificial Sequence: Synthetic oligonucleotide
cuauguggcuauggacuuc

SEQ ID NO: 1288 - RNA, 19 nt, Artificial Sequence
  Description of Artificial Sequence: Synthetic oligonucleotide
gaaguccauagccacauag

SEQ ID NO: 1289 - RNA, 19 nt, Artificial Sequence
  Description of Artificial Sequence: Synthetic oligonucleotide
uauguggcuauggacuucc

SEQ ID NO: 1290 - RNA, 19 nt, Artificial Sequence
  Description of Artificial Sequence: Synthetic oligonucleotide
ggaaguccauagccacaua

SEQ ID NO: 1291 - RNA, 19 nt, Artificial Sequence
  Description of Artificial Sequence: Synthetic oligonucleotide
auguggcuauggacuucca

SEQ ID NO: 1292 - RNA, 19 nt, Artificial Sequence
  Description of Artificial Sequence: Synthetic oligonucleotide
uggaaguccauagccacau

SEQ ID NO: 1293 - RNA, 19 nt, Artificial Sequence
  Description of Artificial Sequence: Synthetic oligonucleotide
uguggcuauggacuuccaa

SEQ ID NO: 1294 - RNA, 19 nt, Artificial Sequence
  Description of Artificial Sequence: Synthetic oligonucleotide
uuggaaguccauagccaca

SEQ ID NO: 1295 - RNA, 19 nt, Artificial Sequence
  Description of Artificial Sequence: Synthetic oligonucleotide
guggcuauggacuuccaag

SEQ ID NO: 1296 - RNA, 19 nt, Artificial Sequence
  Description of Artificial Sequence: Synthetic oligonucleotide
cuuggaaguccauagccac

SEQ ID NO: 1297 - RNA, 19 nt, Artificial Sequence
  Description of Artificial Sequence: Synthetic oligonucleotide
uggcuauggacuuccaagc

SEQ ID NO: 1298 - RNA, 19 nt, Artificial Sequence
  Description of Artificial Sequence: Synthetic oligonucleotide
gcuuggaaguccauagcca

SEQ ID NO: 1299 - RNA, 19 nt, Artificial Sequence
  Description of Artificial Sequence: Synthetic oligonucleotide
gcuauggacuuccaagcca

SEQ ID NO: 1300 - RNA, 19 nt, Artificial Sequence
  Description of Artificial Sequence: Synthetic oligonucleotide
uggcuuggaaguccauagc

SEQ ID NO: 1301 - RNA, 19 nt, Artificial Sequence
  Description of Artificial Sequence: Synthetic oligonucleotide
cuauggacuuccaagccaa

SEQ ID NO: 1302 - RNA, 19 nt, Artificial Sequence
  Description of Artificial Sequence: Synthetic oligonucleotide
uuggcuuggaaguccauag

SEQ ID NO: 1303 - RNA, 19 nt, Artificial Sequence
  Description of Artificial Sequence: Synthetic oligonucleotide
uauggacuuccaagccaag

SEQ ID NO: 1304 - RNA, 19 nt, Artificial Sequence
  Description of Artificial Sequence: Synthetic oligonucleotide
cuuggcuuggaaguccaua

SEQ ID NO: 1305 - RNA, 19 nt, Artificial Sequence
  Description of Artificial Sequence: Synthetic oligonucleotide
cuuccaagccaaguuaggu

SEQ ID NO: 1306 - RNA, 19 nt, Artificial Sequence
  Description of Artificial Sequence: Synthetic oligonucleotide
accuaacuuggcuuggaag

SEQ ID NO: 1307 - RNA, 19 nt, Artificial Sequence
  Description of Artificial Sequence: Synthetic oligonucleotide
uuccaagccaaguuaggug

SEQ ID NO: 1308 - RNA, 19 nt, Artificial Sequence
  Description of Artificial Sequence: Synthetic oligonucleotide
caccuaacuuggcuuggaa

SEQ ID NO: 1309 - RNA, 19 nt, Artificial Sequence
  Description of Artificial Sequence: Synthetic oligonucleotide
uccaagccaaguuagguga

SEQ ID NO: 1310 - RNA, 19 nt, Artificial Sequence
  Description of Artificial Sequence: Synthetic oligonucleotide
ucaccuaacuuggcuugga

SEQ ID NO: 1311 - RNA, 19 nt, Artificial Sequence
  Description of Artificial Sequence: Synthetic oligonucleotide
ccaagccaaguuaggugau

SEQ ID NO: 1312 - RNA, 19 nt, Artificial Sequence
  Description of Artificial Sequence: Synthetic oligonucleotide
aucaccuaacuuggcuugg

SEQ ID NO: 1313 - RNA, 19 nt, Artificial Sequence
  Description of Artificial Sequence: Synthetic oligonucleotide
caagccaaguuaggugaug

SEQ ID NO: 1314 - RNA, 19 nt, Artificial Sequence
  Description of Artificial Sequence: Synthetic oligonucleotide
caucaccuaacuuggcuug

SEQ ID NO: 1315 - RNA, 19 nt, Artificial Sequence
  Description of Artificial Sequence: Synthetic oligonucleotide
aagccaaguuaggugaugg

SEQ ID NO: 1316 - RNA, 19 nt, Artificial Sequence
  Description of Artificial Sequence: Synthetic oligonucleotide
ccaucaccuaacuuggcuu

SEQ ID NO: 1317 - RNA, 19 nt, Artificial Sequence
  Description of Artificial Sequence: Synthetic oligonucleotide
ccaaguuaggugauggcuu

SEQ ID NO: 1318 - RNA, 19 nt, Artificial Sequence
  Description of Artificial Sequence: Synthetic oligonucleotide
aagccaucaccuaacuugg

SEQ ID NO: 1319 - RNA, 19 nt, Artificial Sequence
  Description of Artificial Sequence: Synthetic oligonucleotide
caaguuaggugauggcuuu

SEQ ID NO: 1320 - RNA, 19 nt, Artificial Sequence
  Description of Artificial Sequence: Synthetic oligonucleotide
aaagccaucaccuaacuug

SEQ ID NO: 1321 - RNA, 19 nt, Artificial Sequence
  Description of Artificial Sequence: Synthetic oligonucleotide
uuaggugauggcuuugaag

SEQ ID NO: 1322 - RNA, 19 nt, Artificial Sequence
  Description of Artificial Sequence: Synthetic oligonucleotide
cuucaaagccaucaccuaa

SEQ ID NO: 1323 - RNA, 19 nt, Artificial Sequence
  Description of Artificial Sequence: Synthetic oligonucleotide
gugauggcuuugaaggguu

SEQ ID NO: 1324 - RNA, 19 nt, Artificial Sequence
  Description of Artificial Sequence: Synthetic oligonucleotide
aacccuucaaagccaucac

SEQ ID NO: 1325 - RNA, 19 nt, Artificial Sequence
  Description of Artificial Sequence: Synthetic oligonucleotide
ugauggcuuugaaggguuu

SEQ ID NO: 1326 - RNA, 19 nt, Artificial Sequence
  Description of Artificial Sequence: Synthetic oligonucleotide
aaacccuucaaagccauca

SEQ ID NO: 1327 - RNA, 19 nt, Artificial Sequence
  Description of Artificial Sequence: Synthetic oligonucleotide
gauggcuuugaaggguuuu

SEQ ID NO: 1328 - RNA, 19 nt, Artificial Sequence
  Description of Artificial Sequence: Synthetic oligonucleotide
aaaacccuucaaagccauc

SEQ ID NO: 1329 - RNA, 19 nt, Artificial Sequence
  Description of Artificial Sequence: Synthetic oligonucleotide
auggcuuugaaggguuuua

SEQ ID NO: 1330 - RNA, 19 nt, Artificial Sequence
  Description of Artificial Sequence: Synthetic oligonucleotide
uaaaacccuucaaagccau

SEQ ID NO: 1331 - RNA, 19 nt, Artificial Sequence
  Description of Artificial Sequence: Synthetic oligonucleotide
uggcuuugaaggguuuuau

SEQ ID NO: 1332 - RNA, 19 nt, Artificial Sequence
  Description of Artificial Sequence: Synthetic oligonucleotide
auaaaacccuucaaagcca

SEQ ID NO: 1333 - RNA, 19 nt, Artificial Sequence
  Description of Artificial Sequence: Synthetic oligonucleotide
ugaaggguuuuauaaaagc

SEQ ID NO: 1334 - RNA, 19 nt, Artificial Sequence
  Description of Artificial Sequence: Synthetic oligonucleotide
gcuuuuauaaaacccuuca

SEQ ID NO: 1335 - RNA, 19 nt, Artificial Sequence
  Description of Artificial Sequence: Synthetic oligonucleotide
gaaggguuuuauaaaagca

SEQ ID NO: 1336 - RNA, 19 nt, Artificial Sequence
  Description of Artificial Sequence: Synthetic oligonucleotide
ugcuuuuauaaaacccuuc

SEQ ID NO: 1337 - RNA, 19 nt, Artificial Sequence
  Description of Artificial Sequence: Synthetic oligonucleotide
aaggguuuuauaaaagcac

SEQ ID NO: 1338 - RNA, 19 nt, Artificial Sequence
  Description of Artificial Sequence: Synthetic oligonucleotide
gugcuuuuauaaaacccuu

SEQ ID NO: 1339 - RNA, 19 nt, Artificial Sequence
  Description of Artificial Sequence: Synthetic oligonucleotide
agauuuugagccaacccag

SEQ ID NO: 1340 - RNA, 19 nt, Artificial Sequence
  Description of Artificial Sequence: Synthetic oligonucleotide
cuggguuggcucaaaaucu

SEQ ID NO: 1341 - RNA, 19 nt, Artificial Sequence
  Description of Artificial Sequence: Synthetic oligonucleotide
gauuuugagccaacccagg

SEQ ID NO: 1342 - RNA, 19 nt, Artificial Sequence
  Description of Artificial Sequence: Synthetic oligonucleotide
ccuggguuggcucaaaauc

SEQ ID NO: 1343 - RNA, 19 nt, Artificial Sequence
  Description of Artificial Sequence: Synthetic oligonucleotide
auuuugagccaacccaggc

SEQ ID NO: 1344 - RNA, 19 nt, Artificial Sequence
  Description of Artificial Sequence: Synthetic oligonucleotide
gccuggguuggcucaaaau

SEQ ID NO: 1345 - RNA, 19 nt, Artificial Sequence
  Description of Artificial Sequence: Synthetic oligonucleotide
agccaacccaggcacgcau

SEQ ID NO: 1346 - RNA, 19 nt, Artificial Sequence
  Description of Artificial Sequence: Synthetic oligonucleotide
augcgugccuggguuggcu

SEQ ID NO: 1347 - RNA, 19 nt, Artificial Sequence
  Description of Artificial Sequence: Synthetic oligonucleotide
aacccaggcacgcauggcu

SEQ ID NO: 1348 - RNA, 19 nt, Artificial Sequence
  Description of Artificial Sequence: Synthetic oligonucleotide
agccaugcgugccuggguu

SEQ ID NO: 1349 - RNA, 19 nt, Artificial Sequence
  Description of Artificial Sequence: Synthetic oligonucleotide
acccaggcacgcauggcuu

SEQ ID NO: 1350 - RNA, 19 nt, Artificial Sequence
  Description of Artificial Sequence: Synthetic oligonucleotide
aagccaugcgugccugggu

SEQ ID NO: 1351 - RNA, 19 nt, Artificial Sequence
  Description of Artificial Sequence: Synthetic oligonucleotide
cccaggcacgcauggcuuu

SEQ ID NO: 1352 - RNA, 19 nt, Artificial Sequence
  Description of Artificial Sequence: Synthetic oligonucleotide
aaagccaugcgugccuggg

SEQ ID NO: 1353 - RNA, 19 nt, Artificial Sequence
  Description of Artificial Sequence: Synthetic oligonucleotide
ccaggcacgcauggcuuuc

SEQ ID NO: 1354 - RNA, 19 nt, Artificial Sequence
  Description of Artificial Sequence: Synthetic oligonucleotide
gaaagccaugcgugccugg

SEQ ID NO: 1355 - RNA, 19 nt, Artificial Sequence
  Description of Artificial Sequence: Synthetic oligonucleotide
caggcacgcauggcuuucc

SEQ ID NO: 1356 - RNA, 19 nt, Artificial Sequence
  Description of Artificial Sequence: Synthetic oligonucleotide
ggaaagccaugcgugccug

SEQ ID NO: 1357 - RNA, 19 nt, Artificial Sequence
  Description of Artificial Sequence: Synthetic oligonucleotide
cacgcauggcuuucccuug

SEQ ID NO: 1358 - RNA, 19 nt, Artificial Sequence
  Description of Artificial Sequence: Synthetic oligonucleotide
caagggaaagccaugcgug

SEQ ID NO: 1359 - RNA, 19 nt, Artificial Sequence
  Description of Artificial Sequence: Synthetic oligonucleotide
cauggcuuucccuugcuuu

SEQ ID NO: 1360 - RNA, 19 nt, Artificial Sequence
  Description of Artificial Sequence: Synthetic oligonucleotide
aaagcaagggaaagccaug

SEQ ID NO: 1361 - RNA, 19 nt, Artificial Sequence
  Description of Artificial Sequence: Synthetic oligonucleotide
gcuuucccuugcuuugaug

SEQ ID NO: 1362 - RNA, 19 nt, Artificial Sequence
  Description of Artificial Sequence: Synthetic oligonucleotide
caucaaagcaagggaaagc

SEQ ID NO: 1363 - RNA, 19 nt, Artificial Sequence
  Description of Artificial Sequence: Synthetic oligonucleotide
cuuucccuugcuuugauga

SEQ ID NO: 1364 - RNA, 19 nt, Artificial Sequence
  Description of Artificial Sequence: Synthetic oligonucleotide
ucaucaaagcaagggaaag

SEQ ID NO: 1365 - RNA, 19 nt, Artificial Sequence
  Description of Artificial Sequence: Synthetic oligonucleotide
uuucccuugcuuugaugaa

SEQ ID NO: 1366 - RNA, 19 nt, Artificial Sequence
  Description of Artificial Sequence: Synthetic oligonucleotide
uucaucaaagcaagggaaa

SEQ ID NO: 1367 - RNA, 19 nt, Artificial Sequence
  Description of Artificial Sequence: Synthetic oligonucleotide
aagccaacuuuucaaucaa

SEQ ID NO: 1368 - RNA, 19 nt, Artificial Sequence
  Description of Artificial Sequence: Synthetic oligonucleotide
uugauugaaaaguuggcuu

SEQ ID NO: 1369 - RNA, 19 nt, Artificial Sequence
  Description of Artificial Sequence: Synthetic oligonucleotide
agccaacuuuucaaucaag

SEQ ID NO: 1370 - RNA, 19 nt, Artificial Sequence
  Description of Artificial Sequence: Synthetic oligonucleotide
cuugauugaaaaguuggcu

SEQ ID NO: 1371 - RNA, 19 nt, Artificial Sequence
  Description of Artificial Sequence: Synthetic oligonucleotide
gccaacuuuucaaucaaga

SEQ ID NO: 1372 - RNA, 19 nt, Artificial Sequence
  Description of Artificial Sequence: Synthetic oligonucleotide
ucuugauugaaaaguuggc

SEQ ID NO: 1373 - RNA, 19 nt, Artificial Sequence
  Description of Artificial Sequence: Synthetic oligonucleotide
ccaacuuuucaaucaagau

SEQ ID NO: 1374 - RNA, 19 nt, Artificial Sequence
  Description of Artificial Sequence: Synthetic oligonucleotide
aucuugauugaaaaguugg

SEQ ID NO: 1375 - RNA, 19 nt, Artificial Sequence
  Description of Artificial Sequence: Synthetic oligonucleotide
acuuuucaaucaagauacg

SEQ ID NO: 1376 - RNA, 19 nt, Artificial Sequence
  Description of Artificial Sequence: Synthetic oligonucleotide
cguaucuugauugaaaagu

SEQ ID NO: 1377 - RNA, 19 nt, Artificial Sequence
  Description of Artificial Sequence: Synthetic oligonucleotide
cuuuucaaucaagauacga

SEQ ID NO: 1378 - RNA, 19 nt, Artificial Sequence
  Description of Artificial Sequence: Synthetic oligonucleotide
ucguaucuugauugaaaag

SEQ ID NO: 1379 - RNA, 19 nt, Artificial Sequence
  Description of Artificial Sequence: Synthetic oligonucleotide
uuucaaucaagauacgaag

SEQ ID NO: 1380 - RNA, 19 nt, Artificial Sequence
  Description of Artificial Sequence: Synthetic oligonucleotide
cuucguaucuugauugaaa

SEQ ID NO: 1381 - RNA, 19 nt, Artificial Sequence
  Description of Artificial Sequence: Synthetic oligonucleotide
uucaaucaagauacgaaga

SEQ ID NO: 1382 - RNA, 19 nt, Artificial Sequence
  Description of Artificial Sequence: Synthetic oligonucleotide
ucuucguaucuugauugaa

SEQ ID NO: 1383 - RNA, 19 nt, Artificial Sequence
  Description of Artificial Sequence: Synthetic oligonucleotide
ucaaucaagauacgaagag

SEQ ID NO: 1384 - RNA, 19 nt, Artificial Sequence
  Description of Artificial Sequence: Synthetic oligonucleotide
cucuucguaucuugauuga

SEQ ID NO: 1385 - RNA, 19 nt, Artificial Sequence
  Description of Artificial Sequence: Synthetic oligonucleotide
gcaggcauauugcacuauc

SEQ ID NO: 1386 - RNA, 19 nt, Artificial Sequence
  Description of Artificial Sequence: Synthetic oligonucleotide
gauagugcaauaugccugc

SEQ ID NO: 1387 - RNA, 19 nt, Artificial Sequence
  Description of Artificial Sequence: Synthetic oligonucleotide
caggcauauugcacuaucc

SEQ ID NO: 1388 - RNA, 19 nt, Artificial Sequence
  Description of Artificial Sequence: Synthetic oligonucleotide
ggauagugcaauaugccug

SEQ ID NO: 1389 - RNA, 19 nt, Artificial Sequence
  Description of Artificial Sequence: Synthetic oligonucleotide
cuugaaggaggucuuuugg

SEQ ID NO: 1390 - RNA, 19 nt, Artificial Sequence
  Description of Artificial Sequence: Synthetic oligonucleotide
ccaaaagaccuccuucaag

SEQ ID NO: 1391 - RNA, 19 nt, Artificial Sequence
  Description of Artificial Sequence: Synthetic oligonucleotide
uugaaggaggucuuuugga

SEQ ID NO: 1392 - RNA, 19 nt, Artificial Sequence
  Description of Artificial Sequence: Synthetic oligonucleotide
uccaaaagaccuccuucaa

SEQ ID NO: 1393 - RNA, 19 nt, Artificial Sequence
  Description of Artificial Sequence: Synthetic oligonucleotide
gaaggaggucuuuuggaag

SEQ ID NO: 1394 - RNA, 19 nt, Artificial Sequence
  Description of Artificial Sequence: Synthetic oligonucleotide
cuuccaaaagaccuccuuc

SEQ ID NO: 1395 - RNA, 19 nt, Artificial Sequence
  Description of Artificial Sequence: Synthetic oligonucleotide
uuuggaagaucacuuugaa

SEQ ID NO: 1396 - RNA, 19 nt, Artificial Sequence
  Description of Artificial Sequence: Synthetic oligonucleotide
uucaaagugaucuuccaaa

SEQ ID NO: 1397 - RNA, 19 nt, Artificial Sequence
  Description of Artificial Sequence: Synthetic oligonucleotide
aaaaugaguacauaccuug

SEQ ID NO: 1398 - RNA, 19 nt, Artificial Sequence
  Description of Artificial Sequence: Synthetic oligonucleotide
caagguauguacucauuuu

SEQ ID NO: 1399 - RNA, 19 nt, Artificial Sequence
  Description of Artificial Sequence: Synthetic oligonucleotide
aaaugaguacauaccuugu

SEQ ID NO: 1400 - RNA, 19 nt, Artificial Sequence
  Description of Artificial Sequence: Synthetic oligonucleotide
acaagguauguacucauuu

SEQ ID NO: 1401 - RNA, 19 nt, Artificial Sequence
  Description of Artificial Sequence: Synthetic oligonucleotide
guagccuacauaguuugug

SEQ ID NO: 1402 - RNA, 19 nt, Artificial Sequence
  Description of Artificial Sequence: Synthetic oligonucleotide
cacaaacuauguaggcuac

SEQ ID NO: 1403 - RNA, 19 nt, Artificial Sequence
  Description of Artificial Sequence: Synthetic oligonucleotide
auaguuugugauuuccacu

SEQ ID NO: 1404 - RNA, 19 nt, Artificial Sequence
  Description of Artificial Sequence: Synthetic oligonucleotide
aguggaaaucacaaacuau

SEQ ID NO: 1405 - RNA, 19 nt, Artificial Sequence
  Description of Artificial Sequence: Synthetic oligonucleotide
uaguuugugauuuccacuc

SEQ ID NO: 1406 - RNA, 19 nt, Artificial Sequence
  Description of Artificial Sequence: Synthetic oligonucleotide
gaguggaaaucacaaacua

SEQ ID NO: 1407 - RNA, 19 nt, Artificial Sequence
  Description of Artificial Sequence: Synthetic oligonucleotide
aguuugugauuuccacucu

SEQ ID NO: 1408 - RNA, 19 nt, Artificial Sequence
  Description of Artificial Sequence: Synthetic oligonucleotide
agaguggaaaucacaaacu

SEQ ID NO: 1409 - RNA, 19 nt, Artificial Sequence
  Description of Artificial Sequence: Synthetic oligonucleotide
guuugugauuuccacucuc

SEQ ID NO: 1410 - RNA, 19 nt, Artificial Sequence
  Description of Artificial Sequence: Synthetic oligonucleotide
gagaguggaaaucacaaac

SEQ ID NO: 1411 - RNA, 19 nt, Artificial Sequence
  Description of Artificial Sequence: Synthetic oligonucleotide
uuugugauuuccacucucu

SEQ ID NO: 1412 - RNA, 19 nt, Artificial Sequence
  Description of Artificial Sequence: Synthetic oligonucleotide
agagaguggaaaucacaaa

SEQ ID NO: 1413 - RNA, 19 nt, Artificial Sequence
  Description of Artificial Sequence: Synthetic oligonucleotide
uugugauuuccacucucug

SEQ ID NO: 1414 - RNA, 19 nt, Artificial Sequence
  Description of Artificial Sequence: Synthetic oligonucleotide
cagagaguggaaaucacaa

SEQ ID NO: 1415 - RNA, 19 nt, Artificial Sequence
  Description of Artificial Sequence: Synthetic oligonucleotide
ugugauuuccacucucuga

SEQ ID NO: 1416 - RNA, 19 nt, Artificial Sequence
  Description of Artificial Sequence: Synthetic oligonucleotide
ucagagaguggaaaucaca

SEQ ID NO: 1417 - RNA, 19 nt, Artificial Sequence
  Description of Artificial Sequence: Synthetic oligonucleotide
gugauuuccacucucugag

SEQ ID NO: 1418 - RNA, 19 nt, Artificial Sequence
  Description of Artificial Sequence: Synthetic oligonucleotide
cucagagaguggaaaucac

SEQ ID NO: 1419 - RNA, 19 nt, Artificial Sequence
  Description of Artificial Sequence: Synthetic oligonucleotide
gggucaagguguccaucua

SEQ ID NO: 1420 - RNA, 19 nt, Artificial Sequence
  Description of Artificial Sequence: Synthetic oligonucleotide
uagauggacaccuugaccc

SEQ ID NO: 1421 - RNA, 19 nt, Artificial Sequence
  Description of Artificial Sequence: Synthetic oligonucleotide
ggucaagguguccaucuau

SEQ ID NO: 1422 - RNA, 19 nt, Artificial Sequence
  Description of Artificial Sequence: Synthetic oligonucleotide
auagauggacaccuugacc

SEQ ID NO: 1423 - RNA, 19 nt, Artificial Sequence
  Description of Artificial Sequence: Synthetic oligonucleotide
gucaagguguccaucuaug

SEQ ID NO: 1424 - RNA, 19 nt, Artificial Sequence
  Description of Artificial Sequence: Synthetic oligonucleotide
cauagauggacaccuugac

SEQ ID NO: 1425 - RNA, 19 nt, Artificial Sequence
  Description of Artificial Sequence: Synthetic oligonucleotide
ucaagguguccaucuaugc

SEQ ID NO: 1426 - RNA, 19 nt, Artificial Sequence
  Description of Artificial Sequence: Synthetic oligonucleotide
gcauagauggacaccuuga

SEQ ID NO: 1427 - RNA, 19 nt, Artificial Sequence
  Description of Artificial Sequence: Synthetic oligonucleotide
ugcuuugcaggcaucacug

SEQ ID NO: 1428 - RNA, 19 nt, Artificial Sequence
  Description of Artificial Sequence: Synthetic oligonucleotide
cagugaugccugcaaagca

SEQ ID NO: 1429 - RNA, 19 nt, Artificial Sequence
  Description of Artificial Sequence: Synthetic oligonucleotide
gcuuugcaggcaucacuga

SEQ ID NO: 1430 - RNA, 19 nt, Artificial Sequence
  Description of Artificial Sequence: Synthetic oligonucleotide
ucagugaugccugcaaagc

SEQ ID NO: 1431 - RNA, 19 nt, Artificial Sequence
  Description of Artificial Sequence: Synthetic oligonucleotide
cuuugcaggcaucacugaa

SEQ ID NO: 1432 - RNA, 19 nt, Artificial Sequence
  Description of Artificial Sequence: Synthetic oligonucleotide
uucagugaugccugcaaag

SEQ ID NO: 1433 - RNA, 19 nt, Artificial Sequence
  Description of Artificial Sequence: Synthetic oligonucleotide
uuugcaggcaucacugaag

SEQ ID NO: 1434 - RNA, 19 nt, Artificial Sequence
  Description of Artificial Sequence: Synthetic oligonucleotide
cuucagugaugccugcaaa

SEQ ID NO: 1435 - RNA, 19 nt, Artificial Sequence
  Description of Artificial Sequence: Synthetic oligonucleotide
uugcaggcaucacugaagc

SEQ ID NO: 1436 - RNA, 19 nt, Artificial Sequence
  Description of Artificial Sequence: Synthetic oligonucleotide
gcuucagugaugccugcaa

SEQ ID NO: 1437 - RNA, 19 nt, Artificial Sequence
  Description of Artificial Sequence: Synthetic oligonucleotide
caggcaucacugaagcuac

SEQ ID NO: 1438 - RNA, 19 nt, Artificial Sequence
  Description of Artificial Sequence: Synthetic oligonucleotide
guagcuucagugaugccug

SEQ ID NO: 1439 - RNA, 19 nt, Artificial Sequence
  Description of Artificial Sequence: Synthetic oligonucleotide
aggcaucacugaagcuacu

SEQ ID NO: 1440 - RNA, 19 nt, Artificial Sequence
  Description of Artificial Sequence: Synthetic oligonucleotide
aguagcuucagugaugccu

SEQ ID NO: 1441 - RNA, 19 nt, Artificial Sequence
  Description of Artificial Sequence: Synthetic oligonucleotide
ggcaucacugaagcuacuu

SEQ ID NO: 1442 - RNA, 19 nt, Artificial Sequence
  Description of Artificial Sequence: Synthetic oligonucleotide
aaguagcuucagugaugcc

SEQ ID NO: 1443 - RNA, 19 nt, Artificial Sequence
  Description of Artificial Sequence: Synthetic oligonucleotide
auaucuacuauccacucuc

SEQ ID NO: 1444 - RNA, 19 nt, Artificial Sequence
  Description of Artificial Sequence: Synthetic oligonucleotide
gagaguggauaguagauau

SEQ ID NO: 1445 - RNA, 19 nt, Artificial Sequence
  Description of Artificial Sequence: Synthetic oligonucleotide
cuacuauccacucuccaaa

SEQ ID NO: 1446 - RNA, 19 nt, Artificial Sequence
  Description of Artificial Sequence: Synthetic oligonucleotide
uuuggagaguggauaguag

SEQ ID NO: 1447 - RNA, 19 nt, Artificial Sequence
  Description of Artificial Sequence: Synthetic oligonucleotide
cuggauuuaauugcuauuc

SEQ ID NO: 1448 - RNA, 19 nt, Artificial Sequence
  Description of Artificial Sequence: Synthetic oligonucleotide
gaauagcaauuaaauccag

SEQ ID NO: 1449 - RNA, 19 nt, Artificial Sequence
  Description of Artificial Sequence: Synthetic oligonucleotide
uggauuuaauugcuauucc

SEQ ID NO: 1450 - RNA, 19 nt, Artificial Sequence
  Description of Artificial Sequence: Synthetic oligonucleotide
ggaauagcaauuaaaucca

SEQ ID NO: 1451 - RNA, 19 nt, Artificial Sequence
  Description of Artificial Sequence: Synthetic oligonucleotide
ggauuuaauugcuauuccu

SEQ ID NO: 1452 - RNA, 19 nt, Artificial Sequence
  Description of Artificial Sequence: Synthetic oligonucleotide
aggaauagcaauuaaaucc

SEQ ID NO: 1453 - RNA, 19 nt, Artificial Sequence
  Description of Artificial Sequence: Synthetic oligonucleotide
uuaauugcuauuccugacu

SEQ ID NO: 1454 - RNA, 19 nt, Artificial Sequence
  Description of Artificial Sequence: Synthetic oligonucleotide
agucaggaauagcaauuaa

SEQ ID NO: 1455 - RNA, 19 nt, Artificial Sequence
  Description of Artificial Sequence: Synthetic oligonucleotide
uaauugcuauuccugacuu

SEQ ID NO: 1456 - RNA, 19 nt, Artificial Sequence
  Description of Artificial Sequence: Synthetic oligonucleotide
aagucaggaauagcaauua

SEQ ID NO: 1457 - RNA, 19 nt, Artificial Sequence
  Description of Artificial Sequence: Synthetic oligonucleotide
aauugcuauuccugacuuu

SEQ ID NO: 1458 - RNA, 19 nt, Artificial Sequence
  Description of Artificial Sequence: Synthetic oligonucleotide
aaagucaggaauagcaauu

SEQ ID NO: 1459 - RNA, 19 nt, Artificial Sequence
  Description of Artificial Sequence: Synthetic oligonucleotide
auugcuauuccugacuuug

SEQ ID NO: 1460 - RNA, 19 nt, Artificial Sequence
  Description of Artificial Sequence: Synthetic oligonucleotide
caaagucaggaauagcaau

SEQ ID NO: 1461 - RNA, 19 nt, Artificial Sequence
  Description of Artificial Sequence: Synthetic oligonucleotide
uugcuauuccugacuuugc

SEQ ID NO: 1462 - RNA, 19 nt, Artificial Sequence
  Description of Artificial Sequence: Synthetic oligonucleotide
gcaaagucaggaauagcaa

SEQ ID NO: 1463 - RNA, 19 nt, Artificial Sequence
  Description of Artificial Sequence: Synthetic oligonucleotide
ugcuauuccugacuuugca

SEQ ID NO: 1464 - RNA, 19 nt, Artificial Sequence
  Description of Artificial Sequence: Synthetic oligonucleotide
ugcaaagucaggaauagca

SEQ ID NO: 1465 - RNA, 19 nt, Artificial Sequence
  Description of Artificial Sequence: Synthetic oligonucleotide
ccugacuuugcaccuggag

SEQ ID NO: 1466 - RNA, 19 nt, Artificial Sequence
  Description of Artificial Sequence: Synthetic oligonucleotide
cuccaggugcaaagucagg

SEQ ID NO: 1467 - RNA, 19 nt, Artificial Sequence
  Description of Artificial Sequence: Synthetic oligonucleotide
cugacuuugcaccuggagc

SEQ ID NO: 1468 - RNA, 19 nt, Artificial Sequence
  Description of Artificial Sequence: Synthetic oligonucleotide
gcuccaggugcaaagucag

SEQ ID NO: 1469 - RNA, 19 nt, Artificial Sequence
  Description of Artificial Sequence: Synthetic oligonucleotide
gacuuugcaccuggagcca

SEQ ID NO: 1470 - RNA, 19 nt, Artificial Sequence
  Description of Artificial Sequence: Synthetic oligonucleotide
uggcuccaggugcaaaguc

SEQ ID NO: 1471 - RNA, 19 nt, Artificial Sequence
  Description of Artificial Sequence: Synthetic oligonucleotide
uugcaccuggagccaugga

SEQ ID NO: 1472 - RNA, 19 nt, Artificial Sequence
  Description of Artificial Sequence: Synthetic oligonucleotide
uccauggcuccaggugcaa

SEQ ID NO: 1473 - RNA, 19 nt, Artificial Sequence
  Description of Artificial Sequence: Synthetic oligonucleotide
ugcaccuggagccauggaa

SEQ ID NO: 1474 - RNA, 19 nt, Artificial Sequence
  Description of Artificial Sequence: Synthetic oligonucleotide
uuccauggcuccaggugca

SEQ ID NO: 1475 - RNA, 19 nt, Artificial Sequence
  Description of Artificial Sequence: Synthetic oligonucleotide
gggccucauuacauauagg

SEQ ID NO: 1476 - RNA, 19 nt, Artificial Sequence
  Description of Artificial Sequence: Synthetic oligonucleotide
ccuauauguaaugaggccc

SEQ ID NO: 1477 - RNA, 19 nt, Artificial Sequence
  Description of Artificial Sequence: Synthetic oligonucleotide
ggccucauuacauauaggg

SEQ ID NO: 1478 - RNA, 19 nt, Artificial Sequence
  Description of Artificial Sequence: Synthetic oligonucleotide
cccuauauguaaugaggcc

SEQ ID NO: 1479 - RNA, 19 nt, Artificial Sequence
  Description of Artificial Sequence: Synthetic oligonucleotide
gccucauuacauauaggga

SEQ ID NO: 1480 - RNA, 19 nt, Artificial Sequence
  Description of Artificial Sequence: Synthetic oligonucleotide
ucccuauauguaaugaggc

SEQ ID NO: 1481 - RNA, 19 nt, Artificial Sequence
  Description of Artificial Sequence: Synthetic oligonucleotide
ccaagaccucuucugcuuc

SEQ ID NO: 1482 - RNA, 19 nt, Artificial Sequence
  Description of Artificial Sequence: Synthetic oligonucleotide
gaagcagaagaggucuugg

SEQ ID NO: 1483 - RNA, 19 nt, Artificial Sequence
  Description of Artificial Sequence: Synthetic oligonucleotide
caagaccucuucugcuucc

SEQ ID NO: 1484 - RNA, 19 nt, Artificial Sequence
  Description of Artificial Sequence: Synthetic oligonucleotide
ggaagcagaagaggucuug

SEQ ID NO: 1485 - RNA, 19 nt, Artificial Sequence
  Description of Artificial Sequence: Synthetic oligonucleotide
aagaccucuucugcuuccg

SEQ ID NO: 1486 - RNA, 19 nt, Artificial Sequence
  Description of Artificial Sequence: Synthetic oligonucleotide
cggaagcagaagaggucuu

SEQ ID NO: 1487 - RNA, 19 nt, Artificial Sequence
  Description of Artificial Sequence: Synthetic oligonucleotide
agaccucuucugcuuccga

SEQ ID NO: 1488 - RNA, 19 nt, Artificial Sequence
  Description of Artificial Sequence: Synthetic oligonucleotide
ucggaagcagaagaggucu

SEQ ID NO: 1489 - RNA, 19 nt, Artificial Sequence
  Description of Artificial Sequence: Synthetic oligonucleotide
gaccucuucugcuuccgau

SEQ ID NO: 1490 - RNA, 19 nt, Artificial Sequence
  Description of Artificial Sequence: Synthetic oligonucleotide
aucggaagcagaagagguc

SEQ ID NO: 1491 - RNA, 19 nt, Artificial Sequence
  Description of Artificial Sequence: Synthetic oligonucleotide
accucuucugcuuccgaua

SEQ ID NO: 1492 - RNA, 19 nt, Artificial Sequence
  Description of Artificial Sequence: Synthetic oligonucleotide
uaucggaagcagaagaggu

SEQ ID NO: 1493 - RNA, 19 nt, Artificial Sequence
  Description of Artificial Sequence: Synthetic oligonucleotide
ccucuucugcuuccgauaa

SEQ ID NO: 1494 - RNA, 19 nt, Artificial Sequence
  Description of Artificial Sequence: Synthetic oligonucleotide
uuaucggaagcagaagagg

SEQ ID NO: 1495 - RNA, 19 nt, Artificial Sequence
  Description of Artificial Sequence: Synthetic oligonucleotide
cucuucugcuuccgauaaa

SEQ ID NO: 1496 - RNA, 19 nt, Artificial Sequence
  Description of Artificial Sequence: Synthetic oligonucleotide
uuuaucggaagcagaagag

SEQ ID NO: 1497 - RNA, 19 nt, Artificial Sequence
  Description of Artificial Sequence: Synthetic oligonucleotide
cugugggucaccagaguca

SEQ ID NO: 1498 - RNA, 19 nt, Artificial Sequence
  Description of Artificial Sequence: Synthetic oligonucleotide
ugacucuggugacccacag

SEQ ID NO: 1499 - RNA, 19 nt, Artificial Sequence
  Description of Artificial Sequence: Synthetic oligonucleotide
ugugggucaccagagucau

SEQ ID NO: 1500 - RNA, 19 nt, Artificial Sequence
  Description of Artificial Sequence: Synthetic oligonucleotide
augacucuggugacccaca

SEQ ID NO: 1501 - RNA, 19 nt, Artificial Sequence
  Description of Artificial Sequence: Synthetic oligonucleotide
gugggucaccagagucaua

SEQ ID NO: 1502 - RNA, 19 nt, Artificial Sequence
  Description of Artificial Sequence: Synthetic oligonucleotide
uaugacucuggugacccac

SEQ ID NO: 1503 - RNA, 19 nt, Artificial Sequence
  Description of Artificial Sequence: Synthetic oligonucleotide
ugggucaccagagucauag

SEQ ID NO: 1504 - RNA, 19 nt, Artificial Sequence
  Description of Artificial Sequence: Synthetic oligonucleotide
cuaugacucuggugaccca

SEQ ID NO: 1505 - RNA, 19 nt, Artificial Sequence
  Description of Artificial Sequence: Synthetic oligonucleotide
ucaccagagucauagccca

SEQ ID NO: 1506 - RNA, 19 nt, Artificial Sequence
  Description of Artificial Sequence: Synthetic oligonucleotide
ugggcuaugacucugguga

SEQ ID NO: 1507 - RNA, 19 nt, Artificial Sequence
  Description of Artificial Sequence: Synthetic oligonucleotide
accagagucauagcccaug

SEQ ID NO: 1508 - RNA, 19 nt, Artificial Sequence
  Description of Artificial Sequence: Synthetic oligonucleotide
caugggcuaugacucuggu

SEQ ID NO: 1509 - RNA, 19 nt, Artificial Sequence
  Description of Artificial Sequence: Synthetic oligonucleotide
gcgcaccagugguuuggca

SEQ ID NO: 1510 - RNA, 19 nt, Artificial Sequence
  Description of Artificial Sequence: Synthetic oligonucleotide
ugccaaaccacuggugcgc

SEQ ID NO: 1511 - RNA, 19 nt, Artificial Sequence
  Description of Artificial Sequence: Synthetic oligonucleotide
cgcaccagugguuuggcaa

SEQ ID NO: 1512 - RNA, 19 nt, Artificial Sequence
  Description of Artificial Sequence: Synthetic oligonucleotide
uugccaaaccacuggugcg

SEQ ID NO: 1513 - RNA, 19 nt, Artificial Sequence
  Description of Artificial Sequence: Synthetic oligonucleotide
gcaccagugguuuggcaac

SEQ ID NO: 1514 - RNA, 19 nt, Artificial Sequence
  Description of Artificial Sequence: Synthetic oligonucleotide
guugccaaaccacuggugc

SEQ ID NO: 1515 - RNA, 19 nt, Artificial Sequence
  Description of Artificial Sequence: Synthetic oligonucleotide
guuuggcaaccuggucaca

SEQ ID NO: 1516 - RNA, 19 nt, Artificial Sequence
  Description of Artificial Sequence: Synthetic oligonucleotide
ugugaccagguugccaaac

SEQ ID NO: 1517 - RNA, 19 nt, Artificial Sequence
  Description of Artificial Sequence: Synthetic oligonucleotide
aaugguggaaugauauuug

SEQ ID NO: 1518 - RNA, 19 nt, Artificial Sequence
  Description of Artificial Sequence: Synthetic oligonucleotide
caaauaucauuccaccauu

SEQ ID NO: 1519 - RNA, 19 nt, Artificial Sequence
  Description of Artificial Sequence: Synthetic oligonucleotide
augguggaaugauauuugg

SEQ ID NO: 1520 - RNA, 19 nt, Artificial Sequence
  Description of Artificial Sequence: Synthetic oligonucleotide
ccaaauaucauuccaccau

SEQ ID NO: 1521 - RNA, 19 nt, Artificial Sequence
  Description of Artificial Sequence: Synthetic oligonucleotide
ugguggaaugauauuuggc

SEQ ID NO: 1522 - RNA, 19 nt, Artificial Sequence
  Description of Artificial Sequence: Synthetic oligonucleotide
gccaaauaucauuccacca

SEQ ID NO: 1523 - RNA, 19 nt, Artificial Sequence
  Description of Artificial Sequence: Synthetic oligonucleotide
gguggaaugauauuuggcu

SEQ ID NO: 1524 - RNA, 19 nt, Artificial Sequence
  Description of Artificial Sequence: Synthetic oligonucleotide
agccaaauaucauuccacc

SEQ ID NO: 1525 - RNA, 19 nt, Artificial Sequence
  Description of Artificial Sequence: Synthetic oligonucleotide
guggaaugauauuuggcuu

SEQ ID NO: 1526 - RNA, 19 nt, Artificial Sequence
  Description of Artificial Sequence: Synthetic oligonucleotide
aagccaaauaucauuccac

SEQ ID NO: 1527 - RNA, 19 nt, Artificial Sequence
  Description of Artificial Sequence: Synthetic oligonucleotide
uggaaugauauuuggcuua

SEQ ID NO: 1528 - RNA, 19 nt, Artificial Sequence
  Description of Artificial Sequence: Synthetic oligonucleotide
uaagccaaauaucauucca

SEQ ID NO: 1529 - RNA, 19 nt, Artificial Sequence
  Description of Artificial Sequence: Synthetic oligonucleotide
ggaaugauauuuggcuuaa

SEQ ID NO: 1530 - RNA, 19 nt, Artificial Sequence
  Description of Artificial Sequence: Synthetic oligonucleotide
uuaagccaaauaucauucc

SEQ ID NO: 1531 - RNA, 19 nt, Artificial Sequence
  Description of Artificial Sequence: Synthetic oligonucleotide
gaggguuuugcaaaauaca

SEQ ID NO: 1532 - RNA, 19 nt, Artificial Sequence
  Description of Artificial Sequence: Synthetic oligonucleotide
uguauuuugcaaaacccuc

SEQ ID NO: 1533 - RNA, 19 nt, Artificial Sequence
  Description of Artificial Sequence: Synthetic oligonucleotide
aggguuuugcaaaauacau

SEQ ID NO: 1534 - RNA, 19 nt, Artificial Sequence
  Description of Artificial Sequence: Synthetic oligonucleotide
auguauuuugcaaaacccu

SEQ ID NO: 1535 - RNA, 19 nt, Artificial Sequence
  Description of Artificial Sequence: Synthetic oligonucleotide
ggguuuugcaaaauacaug

SEQ ID NO: 1536 - RNA, 19 nt, Artificial Sequence
  Description of Artificial Sequence: Synthetic oligonucleotide
cauguauuuugcaaaaccc

SEQ ID NO: 1537 - RNA, 19 nt, Artificial Sequence
  Description of Artificial Sequence: Synthetic oligonucleotide
gguuuugcaaaauacaugg

SEQ ID NO: 1538 - RNA, 19 nt, Artificial Sequence
  Description of Artificial Sequence: Synthetic oligonucleotide
ccauguauuuugcaaaacc

SEQ ID NO: 1539 - RNA, 19 nt, Artificial Sequence
  Description of Artificial Sequence: Synthetic oligonucleotide
guuuugcaaaauacaugga

SEQ ID NO: 1540 - RNA, 19 nt, Artificial Sequence
  Description of Artificial Sequence: Synthetic oligonucleotide
uccauguauuuugcaaaac

SEQ ID NO: 1541 - RNA, 19 nt, Artificial Sequence
  Description of Artificial Sequence: Synthetic oligonucleotide
aacuuaucgcuguuaaugc

SEQ ID NO: 1542 - RNA, 19 nt, Artificial Sequence
  Description of Artificial Sequence: Synthetic oligonucleotide
gcauuaacagcgauaaguu

SEQ ID NO: 1543 - RNA, 19 nt, Artificial Sequence
  Description of Artificial Sequence: Synthetic oligonucleotide
acuuaucgcuguuaaugcu

SEQ ID NO: 1544 - RNA, 19 nt, Artificial Sequence
  Description of Artificial Sequence: Synthetic oligonucleotide
agcauuaacagcgauaagu

SEQ ID NO: 1545 - RNA, 19 nt, Artificial Sequence
  Description of Artificial Sequence: Synthetic oligonucleotide
cuuaucgcuguuaaugcua

SEQ ID NO: 1546 - RNA, 19 nt, Artificial Sequence
  Description of Artificial Sequence: Synthetic oligonucleotide
uagcauuaacagcgauaag

SEQ ID NO: 1547 - RNA, 19 nt, Artificial Sequence
  Description of Artificial Sequence: Synthetic oligonucleotide
uuaucgcuguuaaugcuac

SEQ ID NO: 1548 - RNA, 19 nt, Artificial Sequence
  Description of Artificial Sequence: Synthetic oligonucleotide
guagcauuaacagcgauaa

SEQ ID NO: 1549 - RNA, 19 nt, Artificial Sequence
  Description of Artificial Sequence: Synthetic oligonucleotide
uaucgcuguuaaugcuaca

SEQ ID NO: 1550 - RNA, 19 nt, Artificial Sequence
  Description of Artificial Sequence: Synthetic oligonucleotide
uguagcauuaacagcgaua

SEQ ID NO: 1551 - RNA, 19 nt, Artificial Sequence
  Description of Artificial Sequence: Synthetic oligonucleotide
uugaauguguguuuugaag

SEQ ID NO: 1552 - RNA, 19 nt, Artificial Sequence
  Description of Artificial Sequence: Synthetic oligonucleotide
cuucaaaacacacauucaa

SEQ ID NO: 1553 - RNA, 19 nt, Artificial Sequence
  Description of Artificial Sequence: Synthetic oligonucleotide
ugaauguguguuuugaagu

SEQ ID NO: 1554 - RNA, 19 nt, Artificial Sequence
  Description of Artificial Sequence: Synthetic oligonucleotide
acuucaaaacacacauuca

SEQ ID NO: 1555 - RNA, 19 nt, Artificial Sequence
  Description of Artificial Sequence: Synthetic oligonucleotide
gaauguguguuuugaagua

SEQ ID NO: 1556 - RNA, 19 nt, Artificial Sequence
  Description of Artificial Sequence: Synthetic oligonucleotide
uacuucaaaacacacauuc

SEQ ID NO: 1557 - RNA, 19 nt, Artificial Sequence
  Description of Artificial Sequence: Synthetic oligonucleotide
uucauugaauucaucccgc

SEQ ID NO: 1558 - RNA, 19 nt, Artificial Sequence
  Description of Artificial Sequence: Synthetic oligonucleotide
gcgggaugaauucaaugaa

SEQ ID NO: 1559 - RNA, 19 nt, Artificial Sequence
  Description of Artificial Sequence: Synthetic oligonucleotide
aauguuugaugaaguuucc

SEQ ID NO: 1560 - RNA, 19 nt, Artificial Sequence
  Description of Artificial Sequence: Synthetic oligonucleotide
ggaaacuucaucaaacauu

SEQ ID NO: 1561 - RNA, 19 nt, Artificial Sequence
  Description of Artificial Sequence: Synthetic oligonucleotide
aagggagcuuguauuuuga

SEQ ID NO: 1562 - RNA, 19 nt, Artificial Sequence
  Description of Artificial Sequence: Synthetic oligonucleotide
ucaaaauacaagcucccuu

SEQ ID NO: 1563 - RNA, 19 nt, Artificial Sequence
  Description of Artificial Sequence: Synthetic oligonucleotide
gggagcuuguauuuugaau

SEQ ID NO: 1564 - RNA, 19 nt, Artificial Sequence
  Description of Artificial Sequence: Synthetic oligonucleotide
auucaaaauacaagcuccc

SEQ ID NO: 1565 - RNA, 19 nt, Artificial Sequence
  Description of Artificial Sequence: Synthetic oligonucleotide
gaauaugcucaaggauuuu

SEQ ID NO: 1566 - RNA, 19 nt, Artificial Sequence
  Description of Artificial Sequence: Synthetic oligonucleotide
aaaauccuugagcauauuc

SEQ ID NO: 1567 - RNA, 19 nt, Artificial Sequence
  Description of Artificial Sequence: Synthetic oligonucleotide
aauaugcucaaggauuuuc

SEQ ID NO: 1568 - RNA, 19 nt, Artificial Sequence
  Description of Artificial Sequence: Synthetic oligonucleotide
gaaaauccuugagcauauu

SEQ ID NO: 1569 - RNA, 19 nt, Artificial Sequence
  Description of Artificial Sequence: Synthetic oligonucleotide
auaugcucaaggauuuucu

SEQ ID NO: 1570 - RNA, 19 nt, Artificial Sequence
  Description of Artificial Sequence: Synthetic oligonucleotide
agaaaauccuugagcauau

SEQ ID NO: 1571 - RNA, 19 nt, Artificial Sequence
  Description of Artificial Sequence: Synthetic oligonucleotide
uaugcucaaggauuuucug

SEQ ID NO: 1572 - RNA, 19 nt, Artificial Sequence
  Description of Artificial Sequence: Synthetic oligonucleotide
cagaaaauccuugagcaua

SEQ ID NO: 1573 - RNA, 19 nt, Artificial Sequence
  Description of Artificial Sequence: Synthetic oligonucleotide
augcucaaggauuuucugg

SEQ ID NO: 1574 - RNA, 19 nt, Artificial Sequence
  Description of Artificial Sequence: Synthetic oligonucleotide
ccagaaaauccuugagcau

SEQ ID NO: 1575 - RNA, 19 nt, Artificial Sequence
  Description of Artificial Sequence: Synthetic oligonucleotide
gcucaaggauuuucugggu

SEQ ID NO: 1576 - RNA, 19 nt, Artificial Sequence
  Description of Artificial Sequence: Synthetic oligonucleotide
acccagaaaauccuugagc

SEQ ID NO: 1577 - RNA, 19 nt, Artificial Sequence
  Description of Artificial Sequence: Synthetic oligonucleotide
cucaaggauuuucugggug

SEQ ID NO: 1578 - RNA, 19 nt, Artificial Sequence
  Description of Artificial Sequence: Synthetic oligonucleotide
cacccagaaaauccuugag

SEQ ID NO: 1579 - RNA, 19 nt, Artificial Sequence
  Description of Artificial Sequence: Synthetic oligonucleotide
ucaaggauuuucuggguga

SEQ ID NO: 1580 - RNA, 19 nt, Artificial Sequence
  Description of Artificial Sequence: Synthetic oligonucleotide
ucacccagaaaauccuuga

SEQ ID NO: 1581 - RNA, 19 nt, Artificial Sequence
  Description of Artificial Sequence: Synthetic oligonucleotide
caaggauuuucugggugag

SEQ ID NO: 1582 - RNA, 19 nt, Artificial Sequence
  Description of Artificial Sequence: Synthetic oligonucleotide
cucacccagaaaauccuug

SEQ ID NO: 1583 - RNA, 19 nt, Artificial Sequence
  Description of Artificial Sequence: Synthetic oligonucleotide
aaggauuuucugggugagg

SEQ ID NO: 1584 - RNA, 19 nt, Artificial Sequence
  Description of Artificial Sequence: Synthetic oligonucleotide
ccucacccagaaaauccuu

SEQ ID NO: 1585 - RNA, 19 nt, Artificial Sequence
  Description of Artificial Sequence: Synthetic oligonucleotide
aggauuuucugggugagga

SEQ ID NO: 1586 - RNA, 19 nt, Artificial Sequence
  Description of Artificial Sequence: Synthetic oligonucleotide
uccucacccagaaaauccu

SEQ ID NO: 1587 - RNA, 19 nt, Artificial Sequence
  Description of Artificial Sequence: Synthetic oligonucleotide
ggauuuucugggugaggag

SEQ ID NO: 1588 - RNA, 19 nt, Artificial Sequence
  Description of Artificial Sequence: Synthetic oligonucleotide
cuccucacccagaaaaucc

SEQ ID NO: 1589 - RNA, 19 nt, Artificial Sequence
  Description of Artificial Sequence: Synthetic oligonucleotide
uaaagaaguucagcuauag

SEQ ID NO: 1590 - RNA, 19 nt, Artificial Sequence
  Description of Artificial Sequence: Synthetic oligonucleotide
cuauagcugaacuucuuua

SEQ ID NO: 1591 - RNA, 19 nt, Artificial Sequence
  Description of Artificial Sequence: Synthetic oligonucleotide
aaagaaguucagcuauaga

SEQ ID NO: 1592 - RNA, 19 nt, Artificial Sequence
  Description of Artificial Sequence: Synthetic oligonucleotide
ucuauagcugaacuucuuu

SEQ ID NO: 1593 - RNA, 19 nt, Artificial Sequence
  Description of Artificial Sequence: Synthetic oligonucleotide
aagaaguucagcuauagaa

SEQ ID NO: 1594 - RNA, 19 nt, Artificial Sequence
  Description of Artificial Sequence: Synthetic oligonucleotide
uucuauagcugaacuucuu

SEQ ID NO: 1595 - RNA, 19 nt, Artificial Sequence
  Description of Artificial Sequence: Synthetic oligonucleotide
aaaugcuaagaaugaugac

SEQ ID NO: 1596 - RNA, 19 nt, Artificial Sequence
  Description of Artificial Sequence: Synthetic oligonucleotide
gucaucauucuuagcauuu

SEQ ID NO: 1597 - RNA, 19 nt, Artificial Sequence
  Description of Artificial Sequence: Synthetic oligonucleotide
aaugcuaagaaugaugacu

SEQ ID NO: 1598 - RNA, 19 nt, Artificial Sequence
  Description of Artificial Sequence: Synthetic oligonucleotide
agucaucauucuuagcauu

SEQ ID NO: 1599 - RNA, 19 nt, Artificial Sequence
  Description of Artificial Sequence: Synthetic oligonucleotide
aagaaugaugacuugugga

SEQ ID NO: 1600 - RNA, 19 nt, Artificial Sequence
  Description of Artificial Sequence: Synthetic oligonucleotide
uccacaagucaucauucuu

SEQ ID NO: 1601 - RNA, 19 nt, Artificial Sequence
  Description of Artificial Sequence: Synthetic oligonucleotide
agaaugaugacuuguggag

SEQ ID NO: 1602 - RNA, 19 nt, Artificial Sequence
  Description of Artificial Sequence: Synthetic oligonucleotide
cuccacaagucaucauucu

SEQ ID NO: 1603 - RNA, 19 nt, Artificial Sequence
  Description of Artificial Sequence: Synthetic oligonucleotide
aaugaugacuuguggagca

SEQ ID NO: 1604 - RNA, 19 nt, Artificial Sequence
  Description of Artificial Sequence: Synthetic oligonucleotide
ugcuccacaagucaucauu

SEQ ID NO: 1605 - RNA, 19 nt, Artificial Sequence
  Description of Artificial Sequence: Synthetic oligonucleotide
augaugacuuguggagcag

SEQ ID NO: 1606 - RNA, 19 nt, Artificial Sequence
  Description of Artificial Sequence: Synthetic oligonucleotide
cugcuccacaagucaucau

SEQ ID NO: 1607 - RNA, 19 nt, Artificial Sequence
  Description of Artificial Sequence: Synthetic oligonucleotide
ugaugacuuguggagcagu

SEQ ID NO: 1608 - RNA, 19 nt, Artificial Sequence
  Description of Artificial Sequence: Synthetic oligonucleotide
acugcuccacaagucauca

SEQ ID NO: 1609 - RNA, 19 nt, Artificial Sequence
  Description of Artificial Sequence: Synthetic oligonucleotide
acuuguggagcagucuguc

SEQ ID NO: 1610 - RNA, 19 nt, Artificial Sequence
  Description of Artificial Sequence: Synthetic oligonucleotide
gacagacugcuccacaagu

SEQ ID NO: 1611 - RNA, 19 nt, Artificial Sequence
  Description of Artificial Sequence: Synthetic oligonucleotide
cuuguggagcagucuguca

SEQ ID NO: 1612 - RNA, 19 nt, Artificial Sequence
  Description of Artificial Sequence: Synthetic oligonucleotide
ugacagacugcuccacaag

SEQ ID NO: 1613 - RNA, 19 nt, Artificial Sequence
  Description of Artificial Sequence: Synthetic oligonucleotide
uuguggagcagucugucaa

SEQ ID NO: 1614 - RNA, 19 nt, Artificial Sequence
  Description of Artificial Sequence: Synthetic oligonucleotide
uugacagacugcuccacaa

SEQ ID NO: 1615 - RNA, 19 nt, Artificial Sequence
  Description of Artificial Sequence: Synthetic oligonucleotide
uguggagcagucugucaaa

SEQ ID NO: 1616 - RNA, 19 nt, Artificial Sequence
  Description of Artificial Sequence: Synthetic oligonucleotide
uuugacagacugcuccaca

SEQ ID NO: 1617 - RNA, 19 nt, Artificial Sequence
  Description of Artificial Sequence: Synthetic oligonucleotide
guggagcagucugucaaau

SEQ ID NO: 1618 - RNA, 19 nt, Artificial Sequence
  Description of Artificial Sequence: Synthetic oligonucleotide
auuugacagacugcuccac

SEQ ID NO: 1619 - RNA, 19 nt, Artificial Sequence
  Description of Artificial Sequence: Synthetic oligonucleotide
uggagcagucugucaaaua

SEQ ID NO: 1620 - RNA, 19 nt, Artificial Sequence
  Description of Artificial Sequence: Synthetic oligonucleotide
uauuugacagacugcucca

SEQ ID NO: 1621 - RNA, 19 nt, Artificial Sequence
  Description of Artificial Sequence: Synthetic oligonucleotide
gcagucugucaaauaguug

SEQ ID NO: 1622 - RNA, 19 nt, Artificial Sequence
  Description of Artificial Sequence: Synthetic oligonucleotide
caacuauuugacagacugc

SEQ ID NO: 1623 - RNA, 19 nt, Artificial Sequence
  Description of Artificial Sequence: Synthetic oligonucleotide
cagucugucaaauaguugu

SEQ ID NO: 1624 - RNA, 19 nt, Artificial Sequence
  Description of Artificial Sequence: Synthetic oligonucleotide
acaacuauuugacagacug

SEQ ID NO: 1625 - RNA, 19 nt, Artificial Sequence
  Description of Artificial Sequence: Synthetic oligonucleotide
agucugucaaauaguuguu

SEQ ID NO: 1626 - RNA, 19 nt, Artificial Sequence
  Description of Artificial Sequence: Synthetic oligonucleotide
aacaacuauuugacagacu

SEQ ID NO: 1627 - RNA, 19 nt, Artificial Sequence
  Description of Artificial Sequence: Synthetic oligonucleotide
gucugucaaauaguuguuu

SEQ ID NO: 1628 - RNA, 19 nt, Artificial Sequence
  Description of Artificial Sequence: Synthetic oligonucleotide
aaacaacuauuugacagac

SEQ ID NO: 1629 - RNA, 19 nt, Artificial Sequence
  Description of Artificial Sequence: Synthetic oligonucleotide
cugucaaauaguuguuuag

SEQ ID NO: 1630 - RNA, 19 nt, Artificial Sequence
  Description of Artificial Sequence: Synthetic oligonucleotide
cuaaacaacuauuugacag

SEQ ID NO: 1631 - RNA, 19 nt, Artificial Sequence
  Description of Artificial Sequence: Synthetic oligonucleotide
gugauuuuacaucuggugg

SEQ ID NO: 1632 - RNA, 19 nt, Artificial Sequence
  Description of Artificial Sequence: Synthetic oligonucleotide
ccaccagauguaaaaucac

SEQ ID NO: 1633 - RNA, 19 nt, Artificial Sequence
  Description of Artificial Sequence: Synthetic oligonucleotide
ugauuuuacaucuggugga

SEQ ID NO: 1634 - RNA, 19 nt, Artificial Sequence
  Description of Artificial Sequence: Synthetic oligonucleotide
uccaccagauguaaaauca

SEQ ID NO: 1635 - RNA, 19 nt, Artificial Sequence
  Description of Artificial Sequence: Synthetic oligonucleotide
gauuuuacaucugguggag

SEQ ID NO: 1636 - RNA, 19 nt, Artificial Sequence
  Description of Artificial Sequence: Synthetic oligonucleotide
cuccaccagauguaaaauc

SEQ ID NO: 1637 - RNA, 19 nt, Artificial Sequence
  Description of Artificial Sequence: Synthetic oligonucleotide
uacaucugguggaguuugu

SEQ ID NO: 1638 - RNA, 19 nt, Artificial Sequence
  Description of Artificial Sequence: Synthetic oligonucleotide
acaaacuccaccagaugua

SEQ ID NO: 1639 - RNA, 19 nt, Artificial Sequence
  Description of Artificial Sequence: Synthetic oligonucleotide
acaucugguggaguuuguc

SEQ ID NO: 1640 - RNA, 19 nt, Artificial Sequence
  Description of Artificial Sequence: Synthetic oligonucleotide
gacaaacuccaccagaugu

SEQ ID NO: 1641 - RNA, 19 nt, Artificial Sequence
  Description of Artificial Sequence: Synthetic oligonucleotide
caucugguggaguuuguca

SEQ ID NO: 1642 - RNA, 19 nt, Artificial Sequence
  Description of Artificial Sequence: Synthetic oligonucleotide
ugacaaacuccaccagaug

SEQ ID NO: 1643 - RNA, 19 nt, Artificial Sequence
  Description of Artificial Sequence: Synthetic oligonucleotide
ugguggaguuugucauucg

SEQ ID NO: 1644 - RNA, 19 nt, Artificial Sequence
  Description of Artificial Sequence: Synthetic oligonucleotide
cgaaugacaaacuccacca

SEQ ID NO: 1645 - RNA, 19 nt, Artificial Sequence
  Description of Artificial Sequence: Synthetic oligonucleotide
gguggaguuugucauucgg

SEQ ID NO: 1646 - RNA, 19 nt, Artificial Sequence
  Description of Artificial Sequence: Synthetic oligonucleotide
ccgaaugacaaacuccacc

SEQ ID NO: 1647 - RNA, 19 nt, Artificial Sequence
  Description of Artificial Sequence: Synthetic oligonucleotide
guggaguuugucauucgga

SEQ ID NO: 1648 - RNA, 19 nt, Artificial Sequence
  Description of Artificial Sequence: Synthetic oligonucleotide
uccgaaugacaaacuccac

SEQ ID NO: 1649 - RNA, 19 nt, Artificial Sequence
  Description of Artificial Sequence: Synthetic oligonucleotide
uggaguuugucauucggau

SEQ ID NO: 1650 - RNA, 19 nt, Artificial Sequence
  Description of Artificial Sequence: Synthetic oligonucleotide
auccgaaugacaaacucca

SEQ ID NO: 1651 - RNA, 19 nt, Artificial Sequence
  Description of Artificial Sequence: Synthetic oligonucleotide
ggaguuugucauucggauc

SEQ ID NO: 1652 - RNA, 19 nt, Artificial Sequence
  Description of Artificial Sequence: Synthetic oligonucleotide
gauccgaaugacaaacucc

SEQ ID NO: 1653 - RNA, 19 nt, Artificial Sequence
  Description of Artificial Sequence: Synthetic oligonucleotide
gaguuugucauucggaucc

SEQ ID NO: 1654 - RNA, 19 nt, Artificial Sequence
  Description of Artificial Sequence: Synthetic oligonucleotide
ggauccgaaugacaaacuc

SEQ ID NO: 1655 - RNA, 19 nt, Artificial Sequence
  Description of Artificial Sequence: Synthetic oligonucleotide
aguuugucauucggauccc

SEQ ID NO: 1656 - RNA, 19 nt, Artificial Sequence
  Description of Artificial Sequence: Synthetic oligonucleotide
gggauccgaaugacaaacu

SEQ ID NO: 1657 - RNA, 19 nt, Artificial Sequence
  Description of Artificial Sequence: Synthetic oligonucleotide
ugucauucggaucccaaga

SEQ ID NO: 1658 - RNA, 19 nt, Artificial Sequence
  Description of Artificial Sequence: Synthetic oligonucleotide
ucuugggauccgaaugaca

SEQ ID NO: 1659 - RNA, 19 nt, Artificial Sequence
  Description of Artificial Sequence: Synthetic oligonucleotide
gucauucggaucccaagau

SEQ ID NO: 1660 - RNA, 19 nt, Artificial Sequence
  Description of Artificial Sequence: Synthetic oligonucleotide
aucuugggauccgaaugac

SEQ ID NO: 1661 - RNA, 19 nt, Artificial Sequence
  Description of Artificial Sequence: Synthetic oligonucleotide
ucauucggaucccaagaug

SEQ ID NO: 1662 - RNA, 19 nt, Artificial Sequence
  Description of Artificial Sequence: Synthetic oligonucleotide
caucuugggauccgaauga

SEQ ID NO: 1663 - RNA, 19 nt, Artificial Sequence
  Description of Artificial Sequence: Synthetic oligonucleotide
cauucggaucccaagauga

SEQ ID NO: 1664 - RNA, 19 nt, Artificial Sequence
  Description of Artificial Sequence: Synthetic oligonucleotide
ucaucuugggauccgaaug

SEQ ID NO: 1665 - RNA, 19 nt, Artificial Sequence
  Description of Artificial Sequence: Synthetic oligonucleotide
auucggaucccaagaugac

SEQ ID NO: 1666 - RNA, 19 nt, Artificial Sequence
  Description of Artificial Sequence: Synthetic oligonucleotide
gucaucuugggauccgaau

SEQ ID NO: 1667 - RNA, 19 nt, Artificial Sequence
  Description of Artificial Sequence: Synthetic oligonucleotide
uucggaucccaagaugaca

SEQ ID NO: 1668 - RNA, 19 nt, Artificial Sequence
  Description of Artificial Sequence: Synthetic oligonucleotide
ugucaucuugggauccgaa

SEQ ID NO: 1669 - RNA, 19 nt, Artificial Sequence
  Description of Artificial Sequence: Synthetic oligonucleotide
acaugcucgccuuucuggg

SEQ ID NO: 1670 - RNA, 19 nt, Artificial Sequence
  Description of Artificial Sequence: Synthetic oligonucleotide
cccagaaaggcgagcaugu

SEQ ID NO: 1671 - RNA, 19 nt, Artificial Sequence
  Description of Artificial Sequence: Synthetic oligonucleotide
aaaaugcagaggucaaaga

SEQ ID NO: 1672 - RNA, 19 nt, Artificial Sequence
  Description of Artificial Sequence: Synthetic oligonucleotide
ucuuugaccucugcauuuu

SEQ ID NO: 1673 - RNA, 19 nt, Artificial Sequence
  Description of Artificial Sequence: Synthetic oligonucleotide
agaugaugacuacauggac

SEQ ID NO: 1674 - RNA, 19 nt, Artificial Sequence
  Description of Artificial Sequence: Synthetic oligonucleotide
guccauguagucaucaucu

SEQ ID NO: 1675 - RNA, 19 nt, Artificial Sequence
  Description of Artificial Sequence: Synthetic oligonucleotide
augaugacuacauggacuc

SEQ ID NO: 1676 - RNA, 19 nt, Artificial Sequence
  Description of Artificial Sequence: Synthetic oligonucleotide
gaguccauguagucaucau

SEQ ID NO: 1677 - RNA, 19 nt, Artificial Sequence
  Description of Artificial Sequence: Synthetic oligonucleotide
ugaugacuacauggacucu

SEQ ID NO: 1678 - RNA, 19 nt, Artificial Sequence
  Description of Artificial Sequence: Synthetic oligonucleotide
agaguccauguagucauca

SEQ ID NO: 1679 - RNA, 19 nt, Artificial Sequence
  Description of Artificial Sequence: Synthetic oligonucleotide
gaugacuacauggacucuc

SEQ ID NO: 1680 - RNA, 19 nt, Artificial Sequence
  Description of Artificial Sequence: Synthetic oligonucleotide
gagaguccauguagucauc

SEQ ID NO: 1681 - RNA, 19 nt, Artificial Sequence
  Description of Artificial Sequence: Synthetic oligonucleotide
gacggguguucacuccgac

SEQ ID NO: 1682 - RNA, 19 nt, Artificial Sequence
  Description of Artificial Sequence: Synthetic oligonucleotide
gucggagugaacacccguc

SEQ ID NO: 1683 - RNA, 19 nt, Artificial Sequence
  Description of Artificial Sequence: Synthetic oligonucleotide
acggguguucacuccgacu

SEQ ID NO: 1684 - RNA, 19 nt, Artificial Sequence
  Description of Artificial Sequence: Synthetic oligonucleotide
agucggagugaacacccgu

SEQ ID NO: 1685 - RNA, 19 nt, Artificial Sequence
  Description of Artificial Sequence: Synthetic oligonucleotide
cggguguucacuccgacug

SEQ ID NO: 1686 - RNA, 19 nt, Artificial Sequence
  Description of Artificial Sequence: Synthetic oligonucleotide
cagucggagugaacacccg

SEQ ID NO: 1687 - RNA, 19 nt, Artificial Sequence
  Description of Artificial Sequence: Synthetic oligonucleotide
ggguguucacuccgacugc

SEQ ID NO: 1688 - RNA, 19 nt, Artificial Sequence
  Description of Artificial Sequence: Synthetic oligonucleotide
gcagucggagugaacaccc

SEQ ID NO: 1689 - RNA, 19 nt, Artificial Sequence
  Description of Artificial Sequence: Synthetic oligonucleotide
gguguucacuccgacugca

SEQ ID NO: 1690 - RNA, 19 nt, Artificial Sequence
  Description of Artificial Sequence: Synthetic oligonucleotide
ugcagucggagugaacacc

SEQ ID NO: 1691 - RNA, 19 nt, Artificial Sequence
  Description of Artificial Sequence: Synthetic oligonucleotide
guguucacuccgacugcaa

SEQ ID NO: 1692 - RNA, 19 nt, Artificial Sequence
  Description of Artificial Sequence: Synthetic oligonucleotide
uugcagucggagugaacac

SEQ ID NO: 1693 - RNA, 19 nt, Artificial Sequence
  Description of Artificial Sequence: Synthetic oligonucleotide
uguucacuccgacugcaac

SEQ ID NO: 1694 - RNA, 19 nt, Artificial Sequence
  Description of Artificial Sequence: Synthetic oligonucleotide
guugcagucggagugaaca

SEQ ID NO: 1695 - RNA, 19 nt, Artificial Sequence
  Description of Artificial Sequence: Synthetic oligonucleotide
agagguaccuguggcauau

SEQ ID NO: 1696 - RNA, 19 nt, Artificial Sequence
  Description of Artificial Sequence: Synthetic oligonucleotide
auaugccacagguaccucu

SEQ ID NO: 1697 - RNA, 19 nt, Artificial Sequence
  Description of Artificial Sequence: Synthetic oligonucleotide
ccuguggcauaucccauug

SEQ ID NO: 1698 - RNA, 19 nt, Artificial Sequence
  Description of Artificial Sequence: Synthetic oligonucleotide
caaugggauaugccacagg

SEQ ID NO: 1699 - RNA, 19 nt, Artificial Sequence
  Description of Artificial Sequence: Synthetic oligonucleotide
cuguggcauaucccauuga

SEQ ID NO: 1700 - RNA, 19 nt, Artificial Sequence
  Description of Artificial Sequence: Synthetic oligonucleotide
ucaaugggauaugccacag

SEQ ID NO: 1701 - RNA, 19 nt, Artificial Sequence
  Description of Artificial Sequence: Synthetic oligonucleotide
cauaucccauugaccuacu

SEQ ID NO: 1702 - RNA, 19 nt, Artificial Sequence
  Description of Artificial Sequence: Synthetic oligonucleotide
aguaggucaaugggauaug

SEQ ID NO: 1703 - RNA, 19 nt, Artificial Sequence
  Description of Artificial Sequence: Synthetic oligonucleotide
auaucccauugaccuacuc

SEQ ID NO: 1704 - RNA, 19 nt, Artificial Sequence
  Description of Artificial Sequence: Synthetic oligonucleotide
gaguaggucaaugggauau

SEQ ID NO: 1705 - RNA, 19 nt, Artificial Sequence
  Description of Artificial Sequence: Synthetic oligonucleotide
uaucccauugaccuacucc

SEQ ID NO: 1706 - RNA, 19 nt, Artificial Sequence
  Description of Artificial Sequence: Synthetic oligonucleotide
ggaguaggucaaugggaua

SEQ ID NO: 1707 - RNA, 19 nt, Artificial Sequence
  Description of Artificial Sequence: Synthetic oligonucleotide
ccauugaccuacuccacga

SEQ ID NO: 1708 - RNA, 19 nt, Artificial Sequence
  Description of Artificial Sequence: Synthetic oligonucleotide
ucguggaguaggucaaugg

SEQ ID NO: 1709 - RNA, 19 nt, Artificial Sequence
  Description of Artificial Sequence: Synthetic oligonucleotide
cauugaccuacuccacgag

SEQ ID NO: 1710 - RNA, 19 nt, Artificial Sequence
  Description of Artificial Sequence: Synthetic oligonucleotide
cucguggaguaggucaaug

SEQ ID NO: 1711 - RNA, 19 nt, Artificial Sequence
  Description of Artificial Sequence: Synthetic oligonucleotide
cuccacgaguucuucuaau

SEQ ID NO: 1712 - RNA, 19 nt, Artificial Sequence
  Description of Artificial Sequence: Synthetic oligonucleotide
auuagaagaacucguggag

SEQ ID NO: 1713 - RNA, 19 nt, Artificial Sequence
  Description of Artificial Sequence: Synthetic oligonucleotide
uccacgaguucuucuaaug

SEQ ID NO: 1714 - RNA, 19 nt, Artificial Sequence
  Description of Artificial Sequence: Synthetic oligonucleotide
cauuagaagaacucgugga

SEQ ID NO: 1715 - RNA, 19 nt, Artificial Sequence
  Description of Artificial Sequence: Synthetic oligonucleotide
aguucuucuaaugugaucc

SEQ ID NO: 1716 - RNA, 19 nt, Artificial Sequence
  Description of Artificial Sequence: Synthetic oligonucleotide
ggaucacauuagaagaacu

SEQ ID NO: 1717 - RNA, 19 nt, Artificial Sequence
  Description of Artificial Sequence: Synthetic oligonucleotide
guucuucuaaugugaucca

SEQ ID NO: 1718 - RNA, 19 nt, Artificial Sequence
  Description of Artificial Sequence: Synthetic oligonucleotide
uggaucacauuagaagaac

SEQ ID NO: 1719 - RNA, 19 nt, Artificial Sequence
  Description of Artificial Sequence: Synthetic oligonucleotide
uucuucuaaugugauccac

SEQ ID NO: 1720 - RNA, 19 nt, Artificial Sequence
  Description of Artificial Sequence: Synthetic oligonucleotide
guggaucacauuagaagaa

SEQ ID NO: 1721 - RNA, 19 nt, Artificial Sequence
  Description of Artificial Sequence: Synthetic oligonucleotide
aaaagaccaguugggugaa

SEQ ID NO: 1722 - RNA, 19 nt, Artificial Sequence
  Description of Artificial Sequence: Synthetic oligonucleotide
uucacccaacuggucuuuu

SEQ ID NO: 1723 - RNA, 19 nt, Artificial Sequence
  Description of Artificial Sequence: Synthetic oligonucleotide
uuuaauguggacucaaaug

SEQ ID NO: 1724 - RNA, 19 nt, Artificial Sequence
  Description of Artificial Sequence: Synthetic oligonucleotide
cauuugaguccacauuaaa

SEQ ID NO: 1725 - RNA, 19 nt, Artificial Sequence
  Description of Artificial Sequence: Synthetic oligonucleotide
uuaauguggacucaaaugg

SEQ ID NO: 1726 - RNA, 19 nt, Artificial Sequence
  Description of Artificial Sequence: Synthetic oligonucleotide
ccauuugaguccacauuaa

SEQ ID NO: 1727 - RNA, 19 nt, Artificial Sequence
  Description of Artificial Sequence: Synthetic oligonucleotide
uaauguggacucaaauggu

SEQ ID NO: 1728 - RNA, 19 nt, Artificial Sequence
  Description of Artificial Sequence: Synthetic oligonucleotide
accauuugaguccacauua

SEQ ID NO: 1729 - RNA, 19 nt, Artificial Sequence
  Description of Artificial Sequence: Synthetic oligonucleotide
aauguggacucaaaugguu

SEQ ID NO: 1730 - RNA, 19 nt, Artificial Sequence
  Description of Artificial Sequence: Synthetic oligonucleotide
aaccauuugaguccacauu

SEQ ID NO: 1731 - RNA, 19 nt, Artificial Sequence
  Description of Artificial Sequence: Synthetic oligonucleotide
auguggacucaaaugguua

SEQ ID NO: 1732 - RNA, 19 nt, Artificial Sequence
  Description of Artificial Sequence: Synthetic oligonucleotide
uaaccauuugaguccacau

SEQ ID NO: 1733 - RNA, 19 nt, Artificial Sequence
  Description of Artificial Sequence: Synthetic oligonucleotide
uguggacucaaaugguuac

SEQ ID NO: 1734 - RNA, 19 nt, Artificial Sequence
  Description of Artificial Sequence: Synthetic oligonucleotide
guaaccauuugaguccaca

SEQ ID NO: 1735 - RNA, 19 nt, Artificial Sequence
  Description of Artificial Sequence: Synthetic oligonucleotide
guggacucaaaugguuacu

SEQ ID NO: 1736 - RNA, 19 nt, Artificial Sequence
  Description of Artificial Sequence: Synthetic oligonucleotide
aguaaccauuugaguccac

SEQ ID NO: 1737 - RNA, 19 nt, Artificial Sequence
  Description of Artificial Sequence: Synthetic oligonucleotide
uggacucaaaugguuacua

SEQ ID NO: 1738 - RNA, 19 nt, Artificial Sequence
  Description of Artificial Sequence: Synthetic oligonucleotide
uaguaaccauuugagucca

SEQ ID NO: 1739 - RNA, 19 nt, Artificial Sequence
  Description of Artificial Sequence: Synthetic oligonucleotide
ggacucaaaugguuacuac

SEQ ID NO: 1740 - RNA, 19 nt, Artificial Sequence
  Description of Artificial Sequence: Synthetic oligonucleotide
guaguaaccauuugagucc

SEQ ID NO: 1741 - RNA, 19 nt, Artificial Sequence
  Description of Artificial Sequence: Synthetic oligonucleotide
gacucaaaugguuacuaca

SEQ ID NO: 1742 - RNA, 19 nt, Artificial Sequence
  Description of Artificial Sequence: Synthetic oligonucleotide
uguaguaaccauuugaguc

SEQ ID NO: 1743 - RNA, 19 nt, Artificial Sequence
  Description of Artificial Sequence: Synthetic oligonucleotide
caaaugguuacuacaucgu

SEQ ID NO: 1744 - RNA, 19 nt, Artificial Sequence
  Description of Artificial Sequence: Synthetic oligonucleotide
acgauguaguaaccauuug

SEQ ID NO: 1745 - RNA, 19 nt, Artificial Sequence
  Description of Artificial Sequence: Synthetic oligonucleotide
aaugguuacuacaucguuc

SEQ ID NO: 1746 - RNA, 19 nt, Artificial Sequence
  Description of Artificial Sequence: Synthetic oligonucleotide
gaacgauguaguaaccauu

SEQ ID NO: 1747 - RNA, 19 nt, Artificial Sequence
  Description of Artificial Sequence: Synthetic oligonucleotide
augguuacuacaucguuca

SEQ ID NO: 1748 - RNA, 19 nt, Artificial Sequence
  Description of Artificial Sequence: Synthetic oligonucleotide
ugaacgauguaguaaccau

SEQ ID NO: 1749 - RNA, 19 nt, Artificial Sequence
  Description of Artificial Sequence: Synthetic oligonucleotide
ugguuacuacaucguucac

SEQ ID NO: 1750 - RNA, 19 nt, Artificial Sequence
  Description of Artificial Sequence: Synthetic oligonucleotide
gugaacgauguaguaacca

SEQ ID NO: 1751 - RNA, 19 nt, Artificial Sequence
  Description of Artificial Sequence: Synthetic oligonucleotide
gguuacuacaucguucacu

SEQ ID NO: 1752 - RNA, 19 nt, Artificial Sequence
  Description of Artificial Sequence: Synthetic oligonucleotide
agugaacgauguaguaacc

SEQ ID NO: 1753 - RNA, 19 nt, Artificial Sequence
  Description of Artificial Sequence: Synthetic oligonucleotide
guuacuacaucguucacua

SEQ ID NO: 1754 - RNA, 19 nt, Artificial Sequence
  Description of Artificial Sequence: Synthetic oligonucleotide
uagugaacgauguaguaac

SEQ ID NO: 1755 - RNA, 19 nt, Artificial Sequence
  Description of Artificial Sequence: Synthetic oligonucleotide
uuacuacaucguucacuau

SEQ ID NO: 1756 - RNA, 19 nt, Artificial Sequence
  Description of Artificial Sequence: Synthetic oligonucleotide
auagugaacgauguaguaa

SEQ ID NO: 1757 - RNA, 19 nt, Artificial Sequence
  Description of Artificial Sequence: Synthetic oligonucleotide
uacuacaucguucacuaug

SEQ ID NO: 1758 - RNA, 19 nt, Artificial Sequence
  Description of Artificial Sequence: Synthetic oligonucleotide
cauagugaacgauguagua

SEQ ID NO: 1759 - RNA, 19 nt, Artificial Sequence
  Description of Artificial Sequence: Synthetic oligonucleotide
acaucguucacuaugaggg

SEQ ID NO: 1760 - RNA, 19 nt, Artificial Sequence
  Description of Artificial Sequence: Synthetic oligonucleotide
cccucauagugaacgaugu

SEQ ID NO: 1761 - RNA, 19 nt, Artificial Sequence
  Description of Artificial Sequence: Synthetic oligonucleotide
caucguucacuaugagggu

SEQ ID NO: 1762 - RNA, 19 nt, Artificial Sequence
  Description of Artificial Sequence: Synthetic oligonucleotide
acccucauagugaacgaug

SEQ ID NO: 1763 - RNA, 19 nt, Artificial Sequence
  Description of Artificial Sequence: Synthetic oligonucleotide
ugagggucauggaugggac

SEQ ID NO: 1764 - RNA, 19 nt, Artificial Sequence
  Description of Artificial Sequence: Synthetic oligonucleotide
gucccauccaugacccuca

SEQ ID NO: 1765 - RNA, 19 nt, Artificial Sequence
  Description of Artificial Sequence: Synthetic oligonucleotide
cacacuucucagaccuaag

SEQ ID NO: 1766 - RNA, 19 nt, Artificial Sequence
  Description of Artificial Sequence: Synthetic oligonucleotide
cuuaggucugagaagugug

SEQ ID NO: 1767 - RNA, 19 nt, Artificial Sequence
  Description of Artificial Sequence: Synthetic oligonucleotide
acacuucucagaccuaagg

SEQ ID NO: 1768 - RNA, 19 nt, Artificial Sequence
  Description of Artificial Sequence: Synthetic oligonucleotide
ccuuaggucugagaagugu

SEQ ID NO: 1769 - RNA, 19 nt, Artificial Sequence
  Description of Artificial Sequence: Synthetic oligonucleotide
cacuucucagaccuaagga

SEQ ID NO: 1770 - RNA, 19 nt, Artificial Sequence
  Description of Artificial Sequence: Synthetic oligonucleotide
uccuuaggucugagaagug

SEQ ID NO: 1771 - RNA, 19 nt, Artificial Sequence
  Description of Artificial Sequence: Synthetic oligonucleotide
acuucucagaccuaaggac

SEQ ID NO: 1772 - RNA, 19 nt, Artificial Sequence
  Description of Artificial Sequence: Synthetic oligonucleotide
guccuuaggucugagaagu

SEQ ID NO: 1773 - RNA, 19 nt, Artificial Sequence
  Description of Artificial Sequence: Synthetic oligonucleotide
uucucagaccuaaggacag

SEQ ID NO: 1774 - RNA, 19 nt, Artificial Sequence
  Description of Artificial Sequence: Synthetic oligonucleotide
cuguccuuaggucugagaa

SEQ ID NO: 1775 - RNA, 19 nt, Artificial Sequence
  Description of Artificial Sequence: Synthetic oligonucleotide
ucucagaccuaaggacaga

SEQ ID NO: 1776 - RNA, 19 nt, Artificial Sequence
  Description of Artificial Sequence: Synthetic oligonucleotide
ucuguccuuaggucugaga

SEQ ID NO: 1777 - RNA, 19 nt, Artificial Sequence
  Description of Artificial Sequence: Synthetic oligonucleotide
cucagaccuaaggacagag

SEQ ID NO: 1778 - RNA, 19 nt, Artificial Sequence
  Description of Artificial Sequence: Synthetic oligonucleotide
cucuguccuuaggucugag

SEQ ID NO: 1779 - RNA, 19 nt, Artificial Sequence
  Description of Artificial Sequence: Synthetic oligonucleotide
ucagaccuaaggacagagu

SEQ ID NO: 1780 - RNA, 19 nt, Artificial Sequence
  Description of Artificial Sequence: Synthetic oligonucleotide
acucuguccuuaggucuga

SEQ ID NO: 1781 - RNA, 19 nt, Artificial Sequence
  Description of Artificial Sequence: Synthetic oligonucleotide
cagaccuaaggacagagua

SEQ ID NO: 1782 - RNA, 19 nt, Artificial Sequence
  Description of Artificial Sequence: Synthetic oligonucleotide
uacucuguccuuaggucug

SEQ ID NO: 1783 - RNA, 19 nt, Artificial Sequence
  Description of Artificial Sequence: Synthetic oligonucleotide
agaccuaaggacagaguag

SEQ ID NO: 1784 - RNA, 19 nt, Artificial Sequence
  Description of Artificial Sequence: Synthetic oligonucleotide
cuacucuguccuuaggucu

SEQ ID NO: 1785 - RNA, 19 nt, Artificial Sequence
  Description of Artificial Sequence: Synthetic oligonucleotide
ucugauucaugauguguuu

SEQ ID NO: 1786 - RNA, 19 nt, Artificial Sequence
  Description of Artificial Sequence: Synthetic oligonucleotide
aaacacaucaugaaucaga

SEQ ID NO: 1787 - RNA, 19 nt, Artificial Sequence
  Description of Artificial Sequence: Synthetic oligonucleotide
auucaugauguguuucagc

SEQ ID NO: 1788 - RNA, 19 nt, Artificial Sequence
  Description of Artificial Sequence: Synthetic oligonucleotide
gcugaaacacaucaugaau

SEQ ID NO: 1789 - RNA, 19 nt, Artificial Sequence
  Description of Artificial Sequence: Synthetic oligonucleotide
caaagcucuugacaugacu

SEQ ID NO: 1790 - RNA, 19 nt, Artificial Sequence
  Description of Artificial Sequence: Synthetic oligonucleotide
agucaugucaagagcuuug

SEQ ID NO: 1791 - RNA, 19 nt, Artificial Sequence
  Description of Artificial Sequence: Synthetic oligonucleotide
aaagcucuugacaugacuu

SEQ ID NO: 1792 - RNA, 19 nt, Artificial Sequence
  Description of Artificial Sequence: Synthetic oligonucleotide
aagucaugucaagagcuuu

SEQ ID NO: 1793 - RNA, 19 nt, Artificial Sequence
  Description of Artificial Sequence: Synthetic oligonucleotide
aagcucuugacaugacuua

SEQ ID NO: 1794 - RNA, 19 nt, Artificial Sequence
  Description of Artificial Sequence: Synthetic oligonucleotide
uaagucaugucaagagcuu

SEQ ID NO: 1795 - RNA, 19 nt, Artificial Sequence
  Description of Artificial Sequence: Synthetic oligonucleotide
agcucuugacaugacuuac

SEQ ID NO: 1796 - RNA, 19 nt, Artificial Sequence
  Description of Artificial Sequence: Synthetic oligonucleotide
guaagucaugucaagagcu

SEQ ID NO: 1797 - RNA, 19 nt, Artificial Sequence
  Description of Artificial Sequence: Synthetic oligonucleotide
gcucuugacaugacuuacu

SEQ ID NO: 1798 - RNA, 19 nt, Artificial Sequence
  Description of Artificial Sequence: Synthetic oligonucleotide
aguaagucaugucaagagc

SEQ ID NO: 1799 - RNA, 19 nt, Artificial Sequence
  Description of Artificial Sequence: Synthetic oligonucleotide
cucuugacaugacuuacua

SEQ ID NO: 1800 - RNA, 19 nt, Artificial Sequence
  Description of Artificial Sequence: Synthetic oligonucleotide
uaguaagucaugucaagag

SEQ ID NO: 1801 - RNA, 19 nt, Artificial Sequence
  Description of Artificial Sequence: Synthetic oligonucleotide
ucuugacaugacuuacuac

SEQ ID NO: 1802 - RNA, 19 nt, Artificial Sequence
  Description of Artificial Sequence: Synthetic oligonucleotide
guaguaagucaugucaaga

SEQ ID NO: 1803 - RNA, 19 nt, Artificial Sequence
  Description of Artificial Sequence: Synthetic oligonucleotide
cuugacaugacuuacuacc

SEQ ID NO: 1804 - RNA, 19 nt, Artificial Sequence
  Description of Artificial Sequence: Synthetic oligonucleotide
gguaguaagucaugucaag

SEQ ID NO: 1805 - RNA, 19 nt, Artificial Sequence
  Description of Artificial Sequence: Synthetic oligonucleotide
cccgcacuucucgaagguc

SEQ ID NO: 1806 - RNA, 19 nt, Artificial Sequence
  Description of Artificial Sequence: Synthetic oligonucleotide
gaccuucgagaagugcggg

SEQ ID NO: 1807 - RNA, 19 nt, Artificial Sequence
  Description of Artificial Sequence: Synthetic oligonucleotide
ccgcacuucucgaaggucu

SEQ ID NO: 1808 - RNA, 19 nt, Artificial Sequence
  Description of Artificial Sequence: Synthetic oligonucleotide
agaccuucgagaagugcgg

SEQ ID NO: 1809 - RNA, 19 nt, Artificial Sequence
  Description of Artificial Sequence: Synthetic oligonucleotide
gcacuucucgaaggucuga

SEQ ID NO: 1810 - RNA, 19 nt, Artificial Sequence
  Description of Artificial Sequence: Synthetic oligonucleotide
ucagaccuucgagaagugc

SEQ ID NO: 1811 - RNA, 19 nt, Artificial Sequence
  Description of Artificial Sequence: Synthetic oligonucleotide
cacuucucgaaggucugag

SEQ ID NO: 1812 - RNA, 19 nt, Artificial Sequence
  Description of Artificial Sequence: Synthetic oligonucleotide
cucagaccuucgagaagug

SEQ ID NO: 1813 - RNA, 19 nt, Artificial Sequence
  Description of Artificial Sequence: Synthetic oligonucleotide
ucucgaaggucugaguuac

SEQ ID NO: 1814 - RNA, 19 nt, Artificial Sequence
  Description of Artificial Sequence: Synthetic oligonucleotide
guaacucagaccuucgaga

SEQ ID NO: 1815 - RNA, 19 nt, Artificial Sequence
  Description of Artificial Sequence: Synthetic oligonucleotide
cucgaaggucugaguuacu

SEQ ID NO: 1816 - RNA, 19 nt, Artificial Sequence
  Description of Artificial Sequence: Synthetic oligonucleotide
aguaacucagaccuucgag

SEQ ID NO: 1817 - RNA, 19 nt, Artificial Sequence
  Description of Artificial Sequence: Synthetic oligonucleotide
ucgaaggucugaguuacuu

SEQ ID NO: 1818 - RNA, 19 nt, Artificial Sequence
  Description of Artificial Sequence: Synthetic oligonucleotide
aaguaacucagaccuucga

SEQ ID NO: 1819 - RNA, 19 nt, Artificial Sequence
  Description of Artificial Sequence: Synthetic oligonucleotide
cgaaggucugaguuacuug

SEQ ID NO: 1820 - RNA, 19 nt, Artificial Sequence
  Description of Artificial Sequence: Synthetic oligonucleotide
caaguaacucagaccuucg

SEQ ID NO: 1821 - RNA, 19 nt, Artificial Sequence
  Description of Artificial Sequence: Synthetic oligonucleotide
aaggucugaguuacuugga

SEQ ID NO: 1822 - RNA, 19 nt, Artificial Sequence
  Description of Artificial Sequence: Synthetic oligonucleotide
uccaaguaacucagaccuu

SEQ ID NO: 1823 - RNA, 19 nt, Artificial Sequence
  Description of Artificial Sequence: Synthetic oligonucleotide
aggucugaguuacuuggaa

SEQ ID NO: 1824 - RNA, 19 nt, Artificial Sequence
  Description of Artificial Sequence: Synthetic oligonucleotide
uuccaaguaacucagaccu

SEQ ID NO: 1825 - RNA, 19 nt, Artificial Sequence
  Description of Artificial Sequence: Synthetic oligonucleotide
ggucugaguuacuuggaau

SEQ ID NO: 1826 - RNA, 19 nt, Artificial Sequence
  Description of Artificial Sequence: Synthetic oligonucleotide
auuccaaguaacucagacc

SEQ ID NO: 1827 - RNA, 19 nt, Artificial Sequence
  Description of Artificial Sequence: Synthetic oligonucleotide
gucugaguuacuuggaauc

SEQ ID NO: 1828 - RNA, 19 nt, Artificial Sequence
  Description of Artificial Sequence: Synthetic oligonucleotide
gauuccaaguaacucagac

SEQ ID NO: 1829 - RNA, 19 nt, Artificial Sequence
  Description of Artificial Sequence: Synthetic oligonucleotide
ucugaguuacuuggaaucg

SEQ ID NO: 1830 - RNA, 19 nt, Artificial Sequence
  Description of Artificial Sequence: Synthetic oligonucleotide
cgauuccaaguaacucaga

SEQ ID NO: 1831 - RNA, 19 nt, Artificial Sequence
  Description of Artificial Sequence: Synthetic oligonucleotide
cugaguuacuuggaaucgu

SEQ ID NO: 1832 - RNA, 19 nt, Artificial Sequence
  Description of Artificial Sequence: Synthetic oligonucleotide
acgauuccaaguaacucag

SEQ ID NO: 1833 - RNA, 19 nt, Artificial Sequence
  Description of Artificial Sequence: Synthetic oligonucleotide
ugaguuacuuggaaucguu

SEQ ID NO: 1834 - RNA, 19 nt, Artificial Sequence
  Description of Artificial Sequence: Synthetic oligonucleotide
aacgauuccaaguaacuca

SEQ ID NO: 1835 - RNA, 19 nt, Artificial Sequence
  Description of Artificial Sequence: Synthetic oligonucleotide
gaguuacuuggaaucguuu

SEQ ID NO: 1836 - RNA, 19 nt, Artificial Sequence
  Description of Artificial Sequence: Synthetic oligonucleotide
aaacgauuccaaguaacuc

SEQ ID NO: 1837 - RNA, 19 nt, Artificial Sequence
  Description of Artificial Sequence: Synthetic oligonucleotide
aguuacuuggaaucguuuu

SEQ ID NO: 1838 - RNA, 19 nt, Artificial Sequence
  Description of Artificial Sequence: Synthetic oligonucleotide
aaaacgauuccaaguaacu

SEQ ID NO: 1839 - RNA, 19 nt, Artificial Sequence
  Description of Artificial Sequence: Synthetic oligonucleotide
guuacuuggaaucguuuua

SEQ ID NO: 1840 - RNA, 19 nt, Artificial Sequence
  Description of Artificial Sequence: Synthetic oligonucleotide
uaaaacgauuccaaguaac

SEQ ID NO: 1841 - RNA, 19 nt, Artificial Sequence
  Description of Artificial Sequence: Synthetic oligonucleotide
uuacuuggaaucguuuuac

SEQ ID NO: 1842 - RNA, 19 nt, Artificial Sequence
  Description of Artificial Sequence: Synthetic oligonucleotide
guaaaacgauuccaaguaa

SEQ ID NO: 1843 - RNA, 19 nt, Artificial Sequence
  Description of Artificial Sequence: Synthetic oligonucleotide
uacuuggaaucguuuuacc

SEQ ID NO: 1844 - RNA, 19 nt, Artificial Sequence
  Description of Artificial Sequence: Synthetic oligonucleotide
gguaaaacgauuccaagua

SEQ ID NO: 1845 - RNA, 19 nt, Artificial Sequence
  Description of Artificial Sequence: Synthetic oligonucleotide
acuuggaaucguuuuacca

SEQ ID NO: 1846 - RNA, 19 nt, Artificial Sequence
  Description of Artificial Sequence: Synthetic oligonucleotide
ugguaaaacgauuccaagu

SEQ ID NO: 1847 - RNA, 19 nt, Artificial Sequence
  Description of Artificial Sequence: Synthetic oligonucleotide
cuuggaaucguuuuaccac

SEQ ID NO: 1848 - RNA, 19 nt, Artificial Sequence
  Description of Artificial Sequence: Synthetic oligonucleotide
gugguaaaacgauuccaag

SEQ ID NO: 1849 - RNA, 19 nt, Artificial Sequence
  Description of Artificial Sequence: Synthetic oligonucleotide
uuggaaucguuuuaccaca

SEQ ID NO: 1850 - RNA, 19 nt, Artificial Sequence
  Description of Artificial Sequence: Synthetic oligonucleotide
ugugguaaaacgauuccaa

SEQ ID NO: 1851 - RNA, 19 nt, Artificial Sequence
  Description of Artificial Sequence: Synthetic oligonucleotide
aaucguuuuaccacaugau

SEQ ID NO: 1852 - RNA, 19 nt, Artificial Sequence
  Description of Artificial Sequence: Synthetic oligonucleotide
aucaugugguaaaacgauu

SEQ ID NO: 1853 - RNA, 19 nt, Artificial Sequence
  Description of Artificial Sequence: Synthetic oligonucleotide
aucguuuuaccacaugaug

SEQ ID NO: 1854 - RNA, 19 nt, Artificial Sequence
  Description of Artificial Sequence: Synthetic oligonucleotide
caucaugugguaaaacgau

SEQ ID NO: 1855 - RNA, 19 nt, Artificial Sequence
  Description of Artificial Sequence: Synthetic oligonucleotide
ucguuuuaccacaugaugg

SEQ ID NO: 1856 - RNA, 19 nt, Artificial Sequence
  Description of Artificial Sequence: Synthetic oligonucleotide
ccaucaugugguaaaacga

SEQ ID NO: 1857 - RNA, 19 nt, Artificial Sequence
  Description of Artificial Sequence: Synthetic oligonucleotide
cguuuuaccacaugaugga

SEQ ID NO: 1858 - RNA, 19 nt, Artificial Sequence
  Description of Artificial Sequence: Synthetic oligonucleotide
uccaucaugugguaaaacg

SEQ ID NO: 1859 - RNA, 19 nt, Artificial Sequence
  Description of Artificial Sequence: Synthetic oligonucleotide
guuuuaccacaugauggac

SEQ ID NO: 1860 - RNA, 19 nt, Artificial Sequence
  Description of Artificial Sequence: Synthetic oligonucleotide
guccaucaugugguaaaac

SEQ ID NO: 1861 - RNA, 19 nt, Artificial Sequence
  Description of Artificial Sequence: Synthetic oligonucleotide
uuuaccacaugauggacag

SEQ ID NO: 1862 - RNA, 19 nt, Artificial Sequence
  Description of Artificial Sequence: Synthetic oligonucleotide
cuguccaucaugugguaaa

SEQ ID NO: 1863 - RNA, 19 nt, Artificial Sequence
  Description of Artificial Sequence: Synthetic oligonucleotide
uuaccacaugauggacaga

SEQ ID NO: 1864 - RNA, 19 nt, Artificial Sequence
  Description of Artificial Sequence: Synthetic oligonucleotide
ucuguccaucaugugguaa

SEQ ID NO: 1865 - RNA, 19 nt, Artificial Sequence
  Description of Artificial Sequence: Synthetic oligonucleotide
uaccacaugauggacagaa

SEQ ID NO: 1866 - RNA, 19 nt, Artificial Sequence
  Description of Artificial Sequence: Synthetic oligonucleotide
uucuguccaucauguggua

SEQ ID NO: 1867 - RNA, 19 nt, Artificial Sequence
  Description of Artificial Sequence: Synthetic oligonucleotide
accacaugauggacagaag

SEQ ID NO: 1868 - RNA, 19 nt, Artificial Sequence
  Description of Artificial Sequence: Synthetic oligonucleotide
cuucuguccaucauguggu

SEQ ID NO: 1869 - RNA, 19 nt, Artificial Sequence
  Description of Artificial Sequence: Synthetic oligonucleotide
caugauggacagaaggaau

SEQ ID NO: 1870 - RNA, 19 nt, Artificial Sequence
  Description of Artificial Sequence: Synthetic oligonucleotide
auuccuucuguccaucaug

SEQ ID NO: 1871 - RNA, 19 nt, Artificial Sequence
  Description of Artificial Sequence: Synthetic oligonucleotide
ugauggacagaaggaauau

SEQ ID NO: 1872 - RNA, 19 nt, Artificial Sequence
  Description of Artificial Sequence: Synthetic oligonucleotide
auauuccuucuguccauca

SEQ ID NO: 1873 - RNA, 19 nt, Artificial Sequence
  Description of Artificial Sequence: Synthetic oligonucleotide
gauggacagaaggaauauu

SEQ ID NO: 1874 - RNA, 19 nt, Artificial Sequence
  Description of Artificial Sequence: Synthetic oligonucleotide
aauauuccuucuguccauc

SEQ ID NO: 1875 - RNA, 19 nt, Artificial Sequence
  Description of Artificial Sequence: Synthetic oligonucleotide
auggacagaaggaauauuu

SEQ ID NO: 1876 - RNA, 19 nt, Artificial Sequence
  Description of Artificial Sequence: Synthetic oligonucleotide
aaauauuccuucuguccau

SEQ ID NO: 1877 - RNA, 19 nt, Artificial Sequence
  Description of Artificial Sequence: Synthetic oligonucleotide
uggacagaaggaauauuuc

SEQ ID NO: 1878 - RNA, 19 nt, Artificial Sequence
  Description of Artificial Sequence: Synthetic oligonucleotide
gaaauauuccuucugucca

SEQ ID NO: 1879 - RNA, 19 nt, Artificial Sequence
  Description of Artificial Sequence: Synthetic oligonucleotide
cagaaggaauauuucagau

SEQ ID NO: 1880 - RNA, 19 nt, Artificial Sequence
  Description of Artificial Sequence: Synthetic oligonucleotide
aucugaaauauuccuucug

SEQ ID NO: 1881 - RNA, 19 nt, Artificial Sequence
  Description of Artificial Sequence: Synthetic oligonucleotide
cucaagcguuaccuucuuc

SEQ ID NO: 1882 - RNA, 19 nt, Artificial Sequence
  Description of Artificial Sequence: Synthetic oligonucleotide
gaagaagguaacgcuugag

SEQ ID NO: 1883 - RNA, 19 nt, Artificial Sequence
  Description of Artificial Sequence: Synthetic oligonucleotide
agcguuaccuucuucagua

SEQ ID NO: 1884 - RNA, 19 nt, Artificial Sequence
  Description of Artificial Sequence: Synthetic oligonucleotide
uacugaagaagguaacgcu

SEQ ID NO: 1885 - RNA, 19 nt, Artificial Sequence
  Description of Artificial Sequence: Synthetic oligonucleotide
gcguuaccuucuucaguau

SEQ ID NO: 1886 - RNA, 19 nt, Artificial Sequence
  Description of Artificial Sequence: Synthetic oligonucleotide
auacugaagaagguaacgc

SEQ ID NO: 1887 - RNA, 19 nt, Artificial Sequence
  Description of Artificial Sequence: Synthetic oligonucleotide
ccuucuucaguauuuuaag

SEQ ID NO: 1888 - RNA, 19 nt, Artificial Sequence
  Description of Artificial Sequence: Synthetic oligonucleotide
cuuaaaauacugaagaagg

SEQ ID NO: 1889 - RNA, 19 nt, Artificial Sequence
  Description of Artificial Sequence: Synthetic oligonucleotide
uucuucaguauuuuaagcc

SEQ ID NO: 1890 - RNA, 19 nt, Artificial Sequence
  Description of Artificial Sequence: Synthetic oligonucleotide
ggcuuaaaauacugaagaa

SEQ ID NO: 1891 - RNA, 19 nt, Artificial Sequence
  Description of Artificial Sequence: Synthetic oligonucleotide
ucuucaguauuuuaagcca

SEQ ID NO: 1892 - RNA, 19 nt, Artificial Sequence
  Description of Artificial Sequence: Synthetic oligonucleotide
uggcuuaaaauacugaaga

SEQ ID NO: 1893 - RNA, 19 nt, Artificial Sequence
  Description of Artificial Sequence: Synthetic oligonucleotide
auuuuaagccagugauuga

SEQ ID NO: 1894 - RNA, 19 nt, Artificial Sequence
  Description of Artificial Sequence: Synthetic oligonucleotide
ucaaucacuggcuuaaaau

SEQ ID NO: 1895 - RNA, 19 nt, Artificial Sequence
  Description of Artificial Sequence: Synthetic oligonucleotide
uuuuaagccagugauugac

SEQ ID NO: 1896 - RNA, 19 nt, Artificial Sequence
  Description of Artificial Sequence: Synthetic oligonucleotide
gucaaucacuggcuuaaaa

SEQ ID NO: 1897 - RNA, 19 nt, Artificial Sequence
  Description of Artificial Sequence: Synthetic oligonucleotide
uuuaagccagugauugaca

SEQ ID NO: 1898 - RNA, 19 nt, Artificial Sequence
  Description of Artificial Sequence: Synthetic oligonucleotide
ugucaaucacuggcuuaaa

SEQ ID NO: 1899 - RNA, 19 nt, Artificial Sequence
  Description of Artificial Sequence: Synthetic oligonucleotide
uuaagccagugauugacag

SEQ ID NO: 1900 - RNA, 19 nt, Artificial Sequence
  Description of Artificial Sequence: Synthetic oligonucleotide
cugucaaucacuggcuuaa

SEQ ID NO: 1901 - RNA, 19 nt, Artificial Sequence
  Description of Artificial Sequence: Synthetic oligonucleotide
uaagccagugauugacagg

SEQ ID NO: 1902 - RNA, 19 nt, Artificial Sequence
  Description of Artificial Sequence: Synthetic oligonucleotide
ccugucaaucacuggcuua

SEQ ID NO: 1903 - RNA, 19 nt, Artificial Sequence
  Description of Artificial Sequence: Synthetic oligonucleotide
aagccagugauugacaggc

SEQ ID NO: 1904 - RNA, 19 nt, Artificial Sequence
  Description of Artificial Sequence: Synthetic oligonucleotide
gccugucaaucacuggcuu

SEQ ID NO: 1905 - RNA, 19 nt, Artificial Sequence
  Description of Artificial Sequence: Synthetic oligonucleotide
cagugauugacaggcaaag

SEQ ID NO: 1906 - RNA, 19 nt, Artificial Sequence
  Description of Artificial Sequence: Synthetic oligonucleotide
cuuugccugucaaucacug

SEQ ID NO: 1907 - RNA, 19 nt, Artificial Sequence
  Description of Artificial Sequence: Synthetic oligonucleotide
agugauugacaggcaaagc

SEQ ID NO: 1908 - RNA, 19 nt, Artificial Sequence
  Description of Artificial Sequence: Synthetic oligonucleotide
gcuuugccugucaaucacu

SEQ ID NO: 1909 - RNA, 19 nt, Artificial Sequence
  Description of Artificial Sequence: Synthetic oligonucleotide
auugacaggcaaagcugga

SEQ ID NO: 1910 - RNA, 19 nt, Artificial Sequence
  Description of Artificial Sequence: Synthetic oligonucleotide
uccagcuuugccugucaau

SEQ ID NO: 1911 - RNA, 19 nt, Artificial Sequence
  Description of Artificial Sequence: Synthetic oligonucleotide
uugacaggcaaagcuggag

SEQ ID NO: 1912 - RNA, 19 nt, Artificial Sequence
  Description of Artificial Sequence: Synthetic oligonucleotide
cuccagcuuugccugucaa

SEQ ID NO: 1913 - RNA, 19 nt, Artificial Sequence
  Description of Artificial Sequence: Synthetic oligonucleotide
gcucggcucucuugaagcu

SEQ ID NO: 1914 - RNA, 19 nt, Artificial Sequence
  Description of Artificial Sequence: Synthetic oligonucleotide
agcuucaagagagccgagc

SEQ ID NO: 1915 - RNA, 19 nt, Artificial Sequence
  Description of Artificial Sequence: Synthetic oligonucleotide
ucggcucucuugaagcugg

SEQ ID NO: 1916 - RNA, 19 nt, Artificial Sequence
  Description of Artificial Sequence: Synthetic oligonucleotide
ccagcuucaagagagccga

SEQ ID NO: 1917 - RNA, 19 nt, Artificial Sequence
  Description of Artificial Sequence: Synthetic oligonucleotide
cggcucucuugaagcuggc

SEQ ID NO: 1918 - RNA, 19 nt, Artificial Sequence
  Description of Artificial Sequence: Synthetic oligonucleotide
gccagcuucaagagagccg

SEQ ID NO: 1919 - RNA, 19 nt, Artificial Sequence
  Description of Artificial Sequence: Synthetic oligonucleotide
ggcucucuugaagcuggcc

SEQ ID NO: 1920 - RNA, 19 nt, Artificial Sequence
  Description of Artificial Sequence: Synthetic oligonucleotide
ggccagcuucaagagagcc

SEQ ID NO: 1921 - RNA, 19 nt, Artificial Sequence
  Description of Artificial Sequence: Synthetic oligonucleotide
gcucucuugaagcuggccu

SEQ ID NO: 1922 - RNA, 19 nt, Artificial Sequence
  Description of Artificial Sequence: Synthetic oligonucleotide
aggccagcuucaagagagc

SEQ ID NO: 1923 - RNA, 19 nt, Artificial Sequence
  Description of Artificial Sequence: Synthetic oligonucleotide
cucucuugaagcuggccug

SEQ ID NO: 1924 - RNA, 19 nt, Artificial Sequence
  Description of Artificial Sequence: Synthetic oligonucleotide
caggccagcuucaagagag

SEQ ID NO: 1925 - RNA, 19 nt, Artificial Sequence
  Description of Artificial Sequence: Synthetic oligonucleotide
ucucuugaagcuggccugu

SEQ ID NO: 1926 - RNA, 19 nt, Artificial Sequence
  Description of Artificial Sequence: Synthetic oligonucleotide
acaggccagcuucaagaga

SEQ ID NO: 1927 - RNA, 19 nt, Artificial Sequence
  Description of Artificial Sequence: Synthetic oligonucleotide
agcuggccugugaccugaa

SEQ ID NO: 1928 - RNA, 19 nt, Artificial Sequence
  Description of Artificial Sequence: Synthetic oligonucleotide
uucaggucacaggccagcu

SEQ ID NO: 1929 - RNA, 19 nt, Artificial Sequence
  Description of Artificial Sequence: Synthetic oligonucleotide
agauuguguauucuguggg

SEQ ID NO: 1930 - RNA, 19 nt, Artificial Sequence
  Description of Artificial Sequence: Synthetic oligonucleotide
cccacagaauacacaaucu

SEQ ID NO: 1931 - RNA, 19 nt, Artificial Sequence
  Description of Artificial Sequence: Synthetic oligonucleotide
cagcaggauggaauuaccu

SEQ ID NO: 1932 - RNA, 19 nt, Artificial Sequence
  Description of Artificial Sequence: Synthetic oligonucleotide
agguaauuccauccugcug

SEQ ID NO: 1933 - RNA, 19 nt, Artificial Sequence
  Description of Artificial Sequence: Synthetic oligonucleotide
caggauggaauuaccuuuu

SEQ ID NO: 1934 - RNA, 19 nt, Artificial Sequence
  Description of Artificial Sequence: Synthetic oligonucleotide
aaaagguaauuccauccug

SEQ ID NO: 1935 - RNA, 19 nt, Artificial Sequence
  Description of Artificial Sequence: Synthetic oligonucleotide
aggauggaauuaccuuuua

SEQ ID NO: 1936 - RNA, 19 nt, Artificial Sequence
  Description of Artificial Sequence: Synthetic oligonucleotide
uaaaagguaauuccauccu

SEQ ID NO: 1937 - RNA, 19 nt, Artificial Sequence
  Description of Artificial Sequence: Synthetic oligonucleotide
ggauggaauuaccuuuuag

SEQ ID NO: 1938 - RNA, 19 nt, Artificial Sequence
  Description of Artificial Sequence: Synthetic oligonucleotide
cuaaaagguaauuccaucc

SEQ ID NO: 1939 - RNA, 19 nt, Artificial Sequence
  Description of Artificial Sequence: Synthetic oligonucleotide
gauggaauuaccuuuuaga

SEQ ID NO: 1940 - RNA, 19 nt, Artificial Sequence
  Description of Artificial Sequence: Synthetic oligonucleotide
ucuaaaagguaauuccauc

SEQ ID NO: 1941 - RNA, 19 nt, Artificial Sequence
  Description of Artificial Sequence: Synthetic oligonucleotide
auggaauuaccuuuuagag

SEQ ID NO: 1942 - RNA, 19 nt, Artificial Sequence
  Description of Artificial Sequence: Synthetic oligonucleotide
cucuaaaagguaauuccau

SEQ ID NO: 1943 - RNA, 19 nt, Artificial Sequence
  Description of Artificial Sequence: Synthetic oligonucleotide
ggaauuaccuuuuagagca

SEQ ID NO: 1944 - RNA, 19 nt, Artificial Sequence
  Description of Artificial Sequence: Synthetic oligonucleotide
ugcucuaaaagguaauucc

SEQ ID NO: 1945 - RNA, 19 nt, Artificial Sequence
  Description of Artificial Sequence: Synthetic oligonucleotide
gaauuaccuuuuagagcaa

SEQ ID NO: 1946 - RNA, 19 nt, Artificial Sequence
  Description of Artificial Sequence: Synthetic oligonucleotide
uugcucuaaaagguaauuc

SEQ ID NO: 1947 - RNA, 19 nt, Artificial Sequence
  Description of Artificial Sequence: Synthetic oligonucleotide
accuuuuagagcaauauga

SEQ ID NO: 1948 - RNA, 19 nt, Artificial Sequence
  Description of Artificial Sequence: Synthetic oligonucleotide
ucauauugcucuaaaaggu

SEQ ID NO: 1949 - RNA, 19 nt, Artificial Sequence
  Description of Artificial Sequence: Synthetic oligonucleotide
ccuuuuagagcaauaugaa

SEQ ID NO: 1950 - RNA, 19 nt, Artificial Sequence
  Description of Artificial Sequence: Synthetic oligonucleotide
uucauauugcucuaaaagg

SEQ ID NO: 1951 - RNA, 19 nt, Artificial Sequence
  Description of Artificial Sequence: Synthetic oligonucleotide
aacugucaaugucaagugc

SEQ ID NO: 1952 - RNA, 19 nt, Artificial Sequence
  Description of Artificial Sequence: Synthetic oligonucleotide
gcacuugacauugacaguu

SEQ ID NO: 1953 - RNA, 19 nt, Artificial Sequence
  Description of Artificial Sequence: Synthetic oligonucleotide
acugucaaugucaagugcu

SEQ ID NO: 1954 - RNA, 19 nt, Artificial Sequence
  Description of Artificial Sequence: Synthetic oligonucleotide
agcacuugacauugacagu

SEQ ID NO: 1955 - RNA, 19 nt, Artificial Sequence
  Description of Artificial Sequence: Synthetic oligonucleotide
aauucuguaugcuuuguca

SEQ ID NO: 1956 - RNA, 19 nt, Artificial Sequence
  Description of Artificial Sequence: Synthetic oligonucleotide
ugacaaagcauacagaauu

SEQ ID NO: 1957 - RNA, 19 nt, Artificial Sequence
  Description of Artificial Sequence: Synthetic oligonucleotide
cuguaugcuuugucaacga

SEQ ID NO: 1958 - RNA, 19 nt, Artificial Sequence
  Description of Artificial Sequence: Synthetic oligonucleotide
ucguugacaaagcauacag

SEQ ID NO: 1959 - RNA, 19 nt, Artificial Sequence
  Description of Artificial Sequence: Synthetic oligonucleotide
uguaugcuuugucaacgag

SEQ ID NO: 1960 - RNA, 19 nt, Artificial Sequence
  Description of Artificial Sequence: Synthetic oligonucleotide
cucguugacaaagcauaca

SEQ ID NO: 1961 - RNA, 19 nt, Artificial Sequence
  Description of Artificial Sequence: Synthetic oligonucleotide
guaugcuuugucaacgagc

SEQ ID NO: 1962 - RNA, 19 nt, Artificial Sequence
  Description of Artificial Sequence: Synthetic oligonucleotide
gcucguugacaaagcauac

SEQ ID NO: 1963 - RNA, 19 nt, Artificial Sequence
  Description of Artificial Sequence: Synthetic oligonucleotide
cuuugucaacgagcaagca

SEQ ID NO: 1964 - RNA, 19 nt, Artificial Sequence
  Description of Artificial Sequence: Synthetic oligonucleotide
ugcuugcucguugacaaag

SEQ ID NO: 1965 - RNA, 19 nt, Artificial Sequence
  Description of Artificial Sequence: Synthetic oligonucleotide
uuugucaacgagcaagcau

SEQ ID NO: 1966 - RNA, 19 nt, Artificial Sequence
  Description of Artificial Sequence: Synthetic oligonucleotide
augcuugcucguugacaaa

SEQ ID NO: 1967 - RNA, 19 nt, Artificial Sequence
  Description of Artificial Sequence: Synthetic oligonucleotide
uugucaacgagcaagcauc

SEQ ID NO: 1968 - RNA, 19 nt, Artificial Sequence
  Description of Artificial Sequence: Synthetic oligonucleotide
gaugcuugcucguugacaa

SEQ ID NO: 1969 - RNA, 19 nt, Artificial Sequence
  Description of Artificial Sequence: Synthetic oligonucleotide
ugucaacgagcaagcauca

SEQ ID NO: 1970 - RNA, 19 nt, Artificial Sequence
  Description of Artificial Sequence: Synthetic oligonucleotide
ugaugcuugcucguugaca

SEQ ID NO: 1971 - RNA, 19 nt, Artificial Sequence
  Description of Artificial Sequence: Synthetic oligonucleotide
aacuuggcagcucuccuuc

SEQ ID NO: 1972 - RNA, 19 nt, Artificial Sequence
  Description of Artificial Sequence: Synthetic oligonucleotide
gaaggagagcugccaaguu

SEQ ID NO: 1973 - RNA, 19 nt, Artificial Sequence
  Description of Artificial Sequence: Synthetic oligonucleotide
cuuggcagcucuccuucau

SEQ ID NO: 1974 - RNA, 19 nt, Artificial Sequence
  Description of Artificial Sequence: Synthetic oligonucleotide
augaaggagagcugccaag

SEQ ID NO: 1975 - RNA, 19 nt, Artificial Sequence
  Description of Artificial Sequence: Synthetic oligonucleotide
uuggcagcucuccuucaug

SEQ ID NO: 1976 - RNA, 19 nt, Artificial Sequence
  Description of Artificial Sequence: Synthetic oligonucleotide
caugaaggagagcugccaa

SEQ ID NO: 1977 - RNA, 19 nt, Artificial Sequence
  Description of Artificial Sequence: Synthetic oligonucleotide
uggcagcucuccuucaugc

SEQ ID NO: 1978 - RNA, 19 nt, Artificial Sequence
  Description of Artificial Sequence: Synthetic oligonucleotide
gcaugaaggagagcugcca

SEQ ID NO: 1979 - RNA, 19 nt, Artificial Sequence
  Description of Artificial Sequence: Synthetic oligonucleotide
ggcagcucuccuucaugcg

SEQ ID NO: 1980 - RNA, 19 nt, Artificial Sequence
  Description of Artificial Sequence: Synthetic oligonucleotide
cgcaugaaggagagcugcc

SEQ ID NO: 1981 - RNA, 19 nt, Artificial Sequence
  Description of Artificial Sequence: Synthetic oligonucleotide
gcagcucuccuucaugcga

SEQ ID NO: 1982 - RNA, 19 nt, Artificial Sequence
  Description of Artificial Sequence: Synthetic oligonucleotide
ucgcaugaaggagagcugc

SEQ ID NO: 1983 - RNA, 19 nt, Artificial Sequence
  Description of Artificial Sequence: Synthetic oligonucleotide
cagcucuccuucaugcgau

SEQ ID NO: 1984 - RNA, 19 nt, Artificial Sequence
  Description of Artificial Sequence: Synthetic oligonucleotide
aucgcaugaaggagagcug

SEQ ID NO: 1985 - RNA, 19 nt, Artificial Sequence
  Description of Artificial Sequence: Synthetic oligonucleotide
agcucuccuucaugcgauu

SEQ ID NO: 1986 - RNA, 19 nt, Artificial Sequence
  Description of Artificial Sequence: Synthetic oligonucleotide
aaucgcaugaaggagagcu

SEQ ID NO: 1987 - RNA, 19 nt, Artificial Sequence
  Description of Artificial Sequence: Synthetic oligonucleotide
gcucuccuucaugcgauug

SEQ ID NO: 1988 - RNA, 19 nt, Artificial Sequence
  Description of Artificial Sequence: Synthetic oligonucleotide
caaucgcaugaaggagagc

SEQ ID NO: 1989 - RNA, 19 nt, Artificial Sequence
  Description of Artificial Sequence: Synthetic oligonucleotide
cucuccuucaugcgauugc

SEQ ID NO: 1990 - RNA, 19 nt, Artificial Sequence
  Description of Artificial Sequence: Synthetic oligonucleotide
gcaaucgcaugaaggagag

SEQ ID NO: 1991 - RNA, 19 nt, Artificial Sequence
  Description of Artificial Sequence: Synthetic oligonucleotide
ucuccuucaugcgauugcc

SEQ ID NO: 1992 - RNA, 19 nt, Artificial Sequence
  Description of Artificial Sequence: Synthetic oligonucleotide
ggcaaucgcaugaaggaga

SEQ ID NO: 1993 - RNA, 19 nt, Artificial Sequence
  Description of Artificial Sequence: Synthetic oligonucleotide
cuccuucaugcgauugcca

SEQ ID NO: 1994 - RNA, 19 nt, Artificial Sequence
  Description of Artificial Sequence: Synthetic oligonucleotide
uggcaaucgcaugaaggag

SEQ ID NO: 1995 - RNA, 19 nt, Artificial Sequence
  Description of Artificial Sequence: Synthetic oligonucleotide
uccuucaugcgauugccag

SEQ ID NO: 1996 - RNA, 19 nt, Artificial Sequence
  Description of Artificial Sequence: Synthetic oligonucleotide
cuggcaaucgcaugaagga

SEQ ID NO: 1997 - RNA, 19 nt, Artificial Sequence
  Description of Artificial Sequence: Synthetic oligonucleotide
ccuucaugcgauugccaga

SEQ ID NO: 1998 - RNA, 19 nt, Artificial Sequence
  Description of Artificial Sequence: Synthetic oligonucleotide
ucuggcaaucgcaugaagg

SEQ ID NO: 1999 - RNA, 19 nt, Artificial Sequence
  Description of Artificial Sequence: Synthetic oligonucleotide
cuucaugcgauugccagac

SEQ ID NO: 2000 - RNA, 19 nt, Artificial Sequence
  Description of Artificial Sequence: Synthetic oligonucleotide
gucuggcaaucgcaugaag

SEQ ID NO: 2001 - RNA, 19 nt, Artificial Sequence
  Description of Artificial Sequence: Synthetic oligonucleotide
uucaugcgauugccagacg

SEQ ID NO: 2002 - RNA, 19 nt, Artificial Sequence
  Description of Artificial Sequence: Synthetic oligonucleotide
cgucuggcaaucgcaugaa

SEQ ID NO: 2003 - RNA, 19 nt, Artificial Sequence
  Description of Artificial Sequence: Synthetic oligonucleotide
ucaugcgauugccagacgu

SEQ ID NO: 2004 - RNA, 19 nt, Artificial Sequence
  Description of Artificial Sequence: Synthetic oligonucleotide
acgucuggcaaucgcauga

SEQ ID NO: 2005 - RNA, 19 nt, Artificial Sequence
  Description of Artificial Sequence: Synthetic oligonucleotide
caugcgauugccagacguc

SEQ ID NO: 2006 - RNA, 19 nt, Artificial Sequence
  Description of Artificial Sequence: Synthetic oligonucleotide
gacgucuggcaaucgcaug

SEQ ID NO: 2007 - RNA, 19 nt, Artificial Sequence
  Description of Artificial Sequence: Synthetic oligonucleotide
augcgauugccagacgucc

SEQ ID NO: 2008 - RNA, 19 nt, Artificial Sequence
  Description of Artificial Sequence: Synthetic oligonucleotide
ggacgucuggcaaucgcau

SEQ ID NO: 2009 - RNA, 19 nt, Artificial Sequence
  Description of Artificial Sequence: Synthetic oligonucleotide
ugcgauugccagacgucca

SEQ ID NO: 2010 - RNA, 19 nt, Artificial Sequence
  Description of Artificial Sequence: Synthetic oligonucleotide
uggacgucuggcaaucgca

SEQ ID NO: 2011 - RNA, 19 nt, Artificial Sequence
  Description of Artificial Sequence: Synthetic oligonucleotide
gcgauugccagacguccaa

SEQ ID NO: 2012 - RNA, 19 nt, Artificial Sequence
  Description of Artificial Sequence: Synthetic oligonucleotide
uuggacgucuggcaaucgc

SEQ ID NO: 2013 - RNA, 19 nt, Artificial Sequence
  Description of Artificial Sequence: Synthetic oligonucleotide
cgauugccagacguccaaa

SEQ ID NO: 2014 - RNA, 19 nt, Artificial Sequence
  Description of Artificial Sequence: Synthetic oligonucleotide
uuuggacgucuggcaaucg

SEQ ID NO: 2015 - RNA, 19 nt, Artificial Sequence
  Description of Artificial Sequence: Synthetic oligonucleotide
uagcaugggauuuuguaag

SEQ ID NO: 2016 - RNA, 19 nt, Artificial Sequence
  Description of Artificial Sequence: Synthetic oligonucleotide
cuuacaaaaucccaugcua

SEQ ID NO: 2017 - RNA, 19 nt, Artificial Sequence
  Description of Artificial Sequence: Synthetic oligonucleotide
gcaugggauuuuguaagag

SEQ ID NO: 2018 - RNA, 19 nt, Artificial Sequence
  Description of Artificial Sequence: Synthetic oligonucleotide
cucuuacaaaaucccaugc

SEQ ID NO: 2019 - RNA, 19 nt, Artificial Sequence
  Description of Artificial Sequence: Synthetic oligonucleotide
aaaauuggacccaucuucu

SEQ ID NO: 2020 - RNA, 19 nt, Artificial Sequence
  Description of Artificial Sequence: Synthetic oligonucleotide
agaagauggguccaauuuu

SEQ ID NO: 2021 - RNA, 19 nt, Artificial Sequence
  Description of Artificial Sequence: Synthetic oligonucleotide
aaauuggacccaucuucug

SEQ ID NO: 2022 - RNA, 19 nt, Artificial Sequence
  Description of Artificial Sequence: Synthetic oligonucleotide
cagaagauggguccaauuu

SEQ ID NO: 2023 - RNA, 19 nt, Artificial Sequence
  Description of Artificial Sequence: Synthetic oligonucleotide
aauuggacccaucuucuga

SEQ ID NO: 2024 - RNA, 19 nt, Artificial Sequence
  Description of Artificial Sequence: Synthetic oligonucleotide
ucagaagauggguccaauu

SEQ ID NO: 2025 - RNA, 19 nt, Artificial Sequence
  Description of Artificial Sequence: Synthetic oligonucleotide
auuggacccaucuucugaa

SEQ ID NO: 2026 - RNA, 19 nt, Artificial Sequence
  Description of Artificial Sequence: Synthetic oligonucleotide
uucagaagauggguccaau

SEQ ID NO: 2027 - RNA, 19 nt, Artificial Sequence
  Description of Artificial Sequence: Synthetic oligonucleotide
aaaauuugacuugggcuca

SEQ ID NO: 2028 - RNA, 19 nt, Artificial Sequence
  Description of Artificial Sequence: Synthetic oligonucleotide
ugagcccaagucaaauuuu

SEQ ID NO: 2029 - RNA, 19 nt, Artificial Sequence
  Description of Artificial Sequence: Synthetic oligonucleotide
aaauuugacuugggcucau

SEQ ID NO: 2030 - RNA, 19 nt, Artificial Sequence
  Description of Artificial Sequence: Synthetic oligonucleotide
augagcccaagucaaauuu

SEQ ID NO: 2031 - RNA, 19 nt, Artificial Sequence
  Description of Artificial Sequence: Synthetic oligonucleotide
aauuugacuugggcucaua

SEQ ID NO: 2032 - RNA, 19 nt, Artificial Sequence
  Description of Artificial Sequence: Synthetic oligonucleotide
uaugagcccaagucaaauu

SEQ ID NO: 2033 - RNA, 19 nt, Artificial Sequence
  Description of Artificial Sequence: Synthetic oligonucleotide
auuugacuugggcucauau

SEQ ID NO: 2034 - RNA, 19 nt, Artificial Sequence
  Description of Artificial Sequence: Synthetic oligonucleotide
auaugagcccaagucaaau

SEQ ID NO: 2035 - RNA, 19 nt, Artificial Sequence
  Description of Artificial Sequence: Synthetic oligonucleotide
uuugacuugggcucauaug

SEQ ID NO: 2036 - RNA, 19 nt, Artificial Sequence
  Description of Artificial Sequence: Synthetic oligonucleotide
cauaugagcccaagucaaa

SEQ ID NO: 2037 - RNA, 19 nt, Artificial Sequence
  Description of Artificial Sequence: Synthetic oligonucleotide
uugacuugggcucauauga

SEQ ID NO: 2038 - RNA, 19 nt, Artificial Sequence
  Description of Artificial Sequence: Synthetic oligonucleotide
ucauaugagcccaagucaa

SEQ ID NO: 2039 - RNA, 19 nt, Artificial Sequence
  Description of Artificial Sequence: Synthetic oligonucleotide
ugacuugggcucauaugac

SEQ ID NO: 2040 - RNA, 19 nt, Artificial Sequence
  Description of Artificial Sequence: Synthetic oligonucleotide
gucauaugagcccaaguca

SEQ ID NO: 2041 - RNA, 19 nt, Artificial Sequence
  Description of Artificial Sequence: Synthetic oligonucleotide
gacuugggcucauaugaca

SEQ ID NO: 2042 - RNA, 19 nt, Artificial Sequence
  Description of Artificial Sequence: Synthetic oligonucleotide
ugucauaugagcccaaguc

SEQ ID NO: 2043 - RNA, 19 nt, Artificial Sequence
  Description of Artificial Sequence: Synthetic oligonucleotide
acuugggcucauaugacau

SEQ ID NO: 2044 - RNA, 19 nt, Artificial Sequence
  Description of Artificial Sequence: Synthetic oligonucleotide
augucauaugagcccaagu

SEQ ID NO: 2045 - RNA, 19 nt, Artificial Sequence
  Description of Artificial Sequence: Synthetic oligonucleotide
uugggcucauaugacauaa

SEQ ID NO: 2046 - RNA, 19 nt, Artificial Sequence
  Description of Artificial Sequence: Synthetic oligonucleotide
uuaugucauaugagcccaa

SEQ ID NO: 2047 - RNA, 19 nt, Artificial Sequence
  Description of Artificial Sequence: Synthetic oligonucleotide
ugggcucauaugacauaag

SEQ ID NO: 2048 - RNA, 19 nt, Artificial Sequence
  Description of Artificial Sequence: Synthetic oligonucleotide
cuuaugucauaugagccca

SEQ ID NO: 2049 - RNA, 19 nt, Artificial Sequence
  Description of Artificial Sequence: Synthetic oligonucleotide
gggcucauaugacauaagg

SEQ ID NO: 2050 - RNA, 19 nt, Artificial Sequence
  Description of Artificial Sequence: Synthetic oligonucleotide
ccuuaugucauaugagccc

SEQ ID NO: 2051 - RNA, 19 nt, Artificial Sequence
  Description of Artificial Sequence: Synthetic oligonucleotide
ggcucauaugacauaagga

SEQ ID NO: 2052 - RNA, 19 nt, Artificial Sequence
  Description of Artificial Sequence: Synthetic oligonucleotide
uccuuaugucauaugagcc

SEQ ID NO: 2053 - RNA, 19 nt, Artificial Sequence
  Description of Artificial Sequence: Synthetic oligonucleotide
cauaugacauaaggaugau

SEQ ID NO: 2054 - RNA, 19 nt, Artificial Sequence
  Description of Artificial Sequence: Synthetic oligonucleotide
aucauccuuaugucauaug

SEQ ID NO: 2055 - RNA, 19 nt, Artificial Sequence
  Description of Artificial Sequence: Synthetic oligonucleotide
auaugacauaaggaugauc

SEQ ID NO: 2056 - RNA, 19 nt, Artificial Sequence
  Description of Artificial Sequence: Synthetic oligonucleotide
gaucauccuuaugucauau

SEQ ID NO: 2057 - RNA, 19 nt, Artificial Sequence
  Description of Artificial Sequence: Synthetic oligonucleotide
uaugacauaaggaugauca

SEQ ID NO: 2058 - RNA, 19 nt, Artificial Sequence
  Description of Artificial Sequence: Synthetic oligonucleotide
ugaucauccuuaugucaua

SEQ ID NO: 2059 - RNA, 19 nt, Artificial Sequence
  Description of Artificial Sequence: Synthetic oligonucleotide
agcucacuuuucuuccaag

SEQ ID NO: 2060 - RNA, 19 nt, Artificial Sequence
  Description of Artificial Sequence: Synthetic oligonucleotide
cuuggaagaaaagugagcu

SEQ ID NO: 2061 - RNA, 19 nt, Artificial Sequence
  Description of Artificial Sequence: Synthetic oligonucleotide
cuuuucuuccaaggauaag

SEQ ID NO: 2062 - RNA, 19 nt, Artificial Sequence
  Description of Artificial Sequence: Synthetic oligonucleotide
cuuauccuuggaagaaaag

SEQ ID NO: 2063 - RNA, 19 nt, Artificial Sequence
  Description of Artificial Sequence: Synthetic oligonucleotide
uuucuuccaaggauaaguu

SEQ ID NO: 2064 - RNA, 19 nt, Artificial Sequence
  Description of Artificial Sequence: Synthetic oligonucleotide
aacuuauccuuggaagaaa

SEQ ID NO: 2065 - RNA, 19 nt, Artificial Sequence
  Description of Artificial Sequence: Synthetic oligonucleotide
uucuuccaaggauaaguug

SEQ ID NO: 2066 - RNA, 19 nt, Artificial Sequence
  Description of Artificial Sequence: Synthetic oligonucleotide
caacuuauccuuggaagaa

SEQ ID NO: 2067 - RNA, 19 nt, Artificial Sequence
  Description of Artificial Sequence: Synthetic oligonucleotide
ucuuccaaggauaaguugc

SEQ ID NO: 2068 - RNA, 19 nt, Artificial Sequence
  Description of Artificial Sequence: Synthetic oligonucleotide
gcaacuuauccuuggaaga

SEQ ID NO: 2069 - RNA, 19 nt, Artificial Sequence
  Description of Artificial Sequence: Synthetic oligonucleotide
cuuccaaggauaaguugca

SEQ ID NO: 2070 - RNA, 19 nt, Artificial Sequence
  Description of Artificial Sequence: Synthetic oligonucleotide
ugcaacuuauccuuggaag

SEQ ID NO: 2071 - RNA, 19 nt, Artificial Sequence
  Description of Artificial Sequence: Synthetic oligonucleotide
uuccaaggauaaguugcaa

SEQ ID NO: 2072 - RNA, 19 nt, Artificial Sequence
  Description of Artificial Sequence: Synthetic oligonucleotide
uugcaacuuauccuuggaa

SEQ ID NO: 2073 - RNA, 19 nt, Artificial Sequence
  Description of Artificial Sequence: Synthetic oligonucleotide
uccaaggauaaguugcaag

SEQ ID NO: 2074 - RNA, 19 nt, Artificial Sequence
  Description of Artificial Sequence: Synthetic oligonucleotide
cuugcaacuuauccuugga

SEQ ID NO: 2075 - RNA, 19 nt, Artificial Sequence
  Description of Artificial Sequence: Synthetic oligonucleotide
ccaaggauaaguugcaaga

SEQ ID NO: 2076 - RNA, 19 nt, Artificial Sequence
  Description of Artificial Sequence: Synthetic oligonucleotide
ucuugcaacuuauccuugg

SEQ ID NO: 2077 - RNA, 19 nt, Artificial Sequence
  Description of Artificial Sequence: Synthetic oligonucleotide
caaggauaaguugcaagag

SEQ ID NO: 2078 - RNA, 19 nt, Artificial Sequence
  Description of Artificial Sequence: Synthetic oligonucleotide
cucuugcaacuuauccuug

SEQ ID NO: 2079 - RNA, 19 nt, Artificial Sequence
  Description of Artificial Sequence: Synthetic oligonucleotide
aaggauaaguugcaagagg

SEQ ID NO: 2080 - RNA, 19 nt, Artificial Sequence
  Description of Artificial Sequence: Synthetic oligonucleotide
ccucuugcaacuuauccuu

SEQ ID NO: 2081 - RNA, 19 nt, Artificial Sequence
  Description of Artificial Sequence: Synthetic oligonucleotide
aggauaaguugcaagaggu

SEQ ID NO: 2082 - RNA, 19 nt, Artificial Sequence
  Description of Artificial Sequence: Synthetic oligonucleotide
accucuugcaacuuauccu

SEQ ID NO: 2083 - RNA, 19 nt, Artificial Sequence
  Description of Artificial Sequence: Synthetic oligonucleotide
ggauaaguugcaagaggug

SEQ ID NO: 2084 - RNA, 19 nt, Artificial Sequence
  Description of Artificial Sequence: Synthetic oligonucleotide
caccucuugcaacuuaucc

SEQ ID NO: 2085 - RNA, 19 nt, Artificial Sequence
  Description of Artificial Sequence: Synthetic oligonucleotide
gauaaguugcaagagguga

SEQ ID NO: 2086 - RNA, 19 nt, Artificial Sequence
  Description of Artificial Sequence: Synthetic oligonucleotide
ucaccucuugcaacuuauc

SEQ ID NO: 2087 - RNA, 19 nt, Artificial Sequence
  Description of Artificial Sequence: Synthetic oligonucleotide
auaaguugcaagaggugaa

SEQ ID NO: 2088 - RNA, 19 nt, Artificial Sequence
  Description of Artificial Sequence: Synthetic oligonucleotide
uucaccucuugcaacuuau

SEQ ID NO: 2089 - RNA, 19 nt, Artificial Sequence
  Description of Artificial Sequence: Synthetic oligonucleotide
uuuugaaucucuugaggcu

SEQ ID NO: 2090 - RNA, 19 nt, Artificial Sequence
  Description of Artificial Sequence: Synthetic oligonucleotide
agccucaagagauucaaaa

SEQ ID NO: 2091 - RNA, 19 nt, Artificial Sequence
  Description of Artificial Sequence: Synthetic oligonucleotide
uuugaaucucuugaggcuc

SEQ ID NO: 2092 - RNA, 19 nt, Artificial Sequence
  Description of Artificial Sequence: Synthetic oligonucleotide
gagccucaagagauucaaa

SEQ ID NO: 2093 - RNA, 19 nt, Artificial Sequence
  Description of Artificial Sequence: Synthetic oligonucleotide
uugaaucucuugaggcuca

SEQ ID NO: 2094 - RNA, 19 nt, Artificial Sequence
  Description of Artificial Sequence: Synthetic oligonucleotide
ugagccucaagagauucaa

SEQ ID NO: 2095 - RNA, 19 nt, Artificial Sequence
  Description of Artificial Sequence: Synthetic oligonucleotide
gaggcucaaggaucacauc

SEQ ID NO: 2096 - RNA, 19 nt, Artificial Sequence
  Description of Artificial Sequence: Synthetic oligonucleotide
gaugugauccuugagccuc

SEQ ID NO: 2097 - RNA, 19 nt, Artificial Sequence
  Description of Artificial Sequence: Synthetic oligonucleotide
aggcucaaggaucacaucu

SEQ ID NO: 2098 - RNA, 19 nt, Artificial Sequence
  Description of Artificial Sequence: Synthetic oligonucleotide
agaugugauccuugagccu

SEQ ID NO: 2099 - RNA, 19 nt, Artificial Sequence
  Description of Artificial Sequence: Synthetic oligonucleotide
ggcucaaggaucacaucug

SEQ ID NO: 2100 - RNA, 19 nt, Artificial Sequence
  Description of Artificial Sequence: Synthetic oligonucleotide
cagaugugauccuugagcc

SEQ ID NO: 2101 - RNA, 19 nt, Artificial Sequence
  Description of Artificial Sequence: Synthetic oligonucleotide
aggaucacaucuggauauu

SEQ ID NO: 2102 - RNA, 19 nt, Artificial Sequence
  Description of Artificial Sequence: Synthetic oligonucleotide
aauauccagaugugauccu

SEQ ID NO: 2103 - RNA, 19 nt, Artificial Sequence
  Description of Artificial Sequence: Synthetic oligonucleotide
gaucacaucuggauauuuu

SEQ ID NO: 2104 - RNA, 19 nt, Artificial Sequence
  Description of Artificial Sequence: Synthetic oligonucleotide
aaaauauccagaugugauc

SEQ ID NO: 2105 - RNA, 19 nt, Artificial Sequence
  Description of Artificial Sequence: Synthetic oligonucleotide
aaauauaaaauggcuggag

SEQ ID NO: 2106 - RNA, 19 nt, Artificial Sequence
  Description of Artificial Sequence: Synthetic oligonucleotide
cuccagccauuuuauauuu

SEQ ID NO: 2107 - RNA, 19 nt, Artificial Sequence
  Description of Artificial Sequence: Synthetic oligonucleotide
gaggacuuggcuaaugguu

SEQ ID NO: 2108 - RNA, 19 nt, Artificial Sequence
  Description of Artificial Sequence: Synthetic oligonucleotide
aaccauuagccaaguccuc

SEQ ID NO: 2109 - RNA, 19 nt, Artificial Sequence
  Description of Artificial Sequence: Synthetic oligonucleotide
aggacuuggcuaaugguua

SEQ ID NO: 2110 - RNA, 19 nt, Artificial Sequence
  Description of Artificial Sequence: Synthetic oligonucleotide
uaaccauuagccaaguccu

SEQ ID NO: 2111 - RNA, 19 nt, Artificial Sequence
  Description of Artificial Sequence: Synthetic oligonucleotide
ggacuuggcuaaugguuaa

SEQ ID NO: 2112 - RNA, 19 nt, Artificial Sequence
  Description of Artificial Sequence: Synthetic oligonucleotide
uuaaccauuagccaagucc

SEQ ID NO: 2113 - RNA, 19 nt, Artificial Sequence
  Description of Artificial Sequence: Synthetic oligonucleotide
gacuuggcuaaugguuaau

SEQ ID NO: 2114 - RNA, 19 nt, Artificial Sequence
  Description of Artificial Sequence: Synthetic oligonucleotide
auuaaccauuagccaaguc

SEQ ID NO: 2115 - RNA, 19 nt, Artificial Sequence
  Description of Artificial Sequence: Synthetic oligonucleotide
acuuggcuaaugguuaaua

SEQ ID NO: 2116 - RNA, 19 nt, Artificial Sequence
  Description of Artificial Sequence: Synthetic oligonucleotide
uauuaaccauuagccaagu

SEQ ID NO: 2117 - RNA, 19 nt, Artificial Sequence
  Description of Artificial Sequence: Synthetic oligonucleotide
cuuggcuaaugguuaauac

SEQ ID NO: 2118 - RNA, 19 nt, Artificial Sequence
  Description of Artificial Sequence: Synthetic oligonucleotide
guauuaaccauuagccaag

SEQ ID NO: 2119 - RNA, 19 nt, Artificial Sequence
  Description of Artificial Sequence: Synthetic oligonucleotide
uuggcuaaugguuaauacu

SEQ ID NO: 2120 - RNA, 19 nt, Artificial Sequence
  Description of Artificial Sequence: Synthetic oligonucleotide
aguauuaaccauuagccaa

SEQ ID NO: 2121 - RNA, 19 nt, Artificial Sequence
  Description of Artificial Sequence: Synthetic oligonucleotide
uggcuaaugguuaauacuu

SEQ ID NO: 2122 - RNA, 19 nt, Artificial Sequence
  Description of Artificial Sequence: Synthetic oligonucleotide
aaguauuaaccauuagcca

SEQ ID NO: 2123 - RNA, 19 nt, Artificial Sequence
  Description of Artificial Sequence: Synthetic oligonucleotide
cgguggcucacgccuguaa

SEQ ID NO: 2124 - RNA, 19 nt, Artificial Sequence
  Description of Artificial Sequence: Synthetic oligonucleotide
uuacaggcgugagccaccg

SEQ ID NO: 2125 - RNA, 19 nt, Artificial Sequence
  Description of Artificial Sequence: Synthetic oligonucleotide
gguggcucacgccuguaau

SEQ ID NO: 2126 - RNA, 19 nt, Artificial Sequence
  Description of Artificial Sequence: Synthetic oligonucleotide
auuacaggcgugagccacc

SEQ ID NO: 2127 - RNA, 19 nt, Artificial Sequence
  Description of Artificial Sequence: Synthetic oligonucleotide
guggcucacgccuguaauc

SEQ ID NO: 2128 - RNA, 19 nt, Artificial Sequence
  Description of Artificial Sequence: Synthetic oligonucleotide
gauuacaggcgugagccac

SEQ ID NO: 2129 - RNA, 19 nt, Artificial Sequence
  Description of Artificial Sequence: Synthetic oligonucleotide
uggcucacgccuguaaucc

SEQ ID NO: 2130 - RNA, 19 nt, Artificial Sequence
  Description of Artificial Sequence: Synthetic oligonucleotide
ggauuacaggcgugagcca

SEQ ID NO: 2131 - RNA, 19 nt, Artificial Sequence
  Description of Artificial Sequence: Synthetic oligonucleotide
ggcucacgccuguaauccc

SEQ ID NO: 2132 - RNA, 19 nt, Artificial Sequence
  Description of Artificial Sequence: Synthetic oligonucleotide
gggauuacaggcgugagcc

SEQ ID NO: 2133 - RNA, 19 nt, Artificial Sequence
  Description of Artificial Sequence: Synthetic oligonucleotide
acgccuguaaucccagcac

SEQ ID NO: 2134 - RNA, 19 nt, Artificial Sequence
  Description of Artificial Sequence: Synthetic oligonucleotide
gugcugggauuacaggcgu

SEQ ID NO: 2135 - RNA, 19 nt, Artificial Sequence
  Description of Artificial Sequence: Synthetic oligonucleotide
agcacuuugggaggcugag

SEQ ID NO: 2136 - RNA, 19 nt, Artificial Sequence
  Description of Artificial Sequence: Synthetic oligonucleotide
cucagccucccaaagugcu

SEQ ID NO: 2137 - RNA, 19 nt, Artificial Sequence
  Description of Artificial Sequence: Synthetic oligonucleotide
caugguggcaggugccugu

SEQ ID NO: 2138 - RNA, 19 nt, Artificial Sequence
  Description of Artificial Sequence: Synthetic oligonucleotide
acaggcaccugccaccaug

SEQ ID NO: 2139 - RNA, 19 nt, Artificial Sequence
  Description of Artificial Sequence: Synthetic oligonucleotide
augguggcaggugccugua

SEQ ID NO: 2140 - RNA, 19 nt, Artificial Sequence
  Description of Artificial Sequence: Synthetic oligonucleotide
uacaggcaccugccaccau

SEQ ID NO: 2141 - RNA, 19 nt, Artificial Sequence
  Description of Artificial Sequence: Synthetic oligonucleotide
uggcaggugccuguagucc

SEQ ID NO: 2142 - RNA, 19 nt, Artificial Sequence
  Description of Artificial Sequence: Synthetic oligonucleotide
ggacuacaggcaccugcca

SEQ ID NO: 2143 - RNA, 19 nt, Artificial Sequence
  Description of Artificial Sequence: Synthetic oligonucleotide
gcaggugccuguaguccca

SEQ ID NO: 2144 - RNA, 19 nt, Artificial Sequence
  Description of Artificial Sequence: Synthetic oligonucleotide
ugggacuacaggcaccugc

SEQ ID NO: 2145 - RNA, 19 nt, Artificial Sequence
  Description of Artificial Sequence: Synthetic oligonucleotide
gugccuguagucccagcua

SEQ ID NO: 2146 - RNA, 19 nt, Artificial Sequence
  Description of Artificial Sequence: Synthetic oligonucleotide
uagcugggacuacaggcac

SEQ ID NO: 2147 - RNA, 19 nt, Artificial Sequence
  Description of Artificial Sequence: Synthetic oligonucleotide
uagucccagcuacucggca

SEQ ID NO: 2148 - RNA, 19 nt, Artificial Sequence
  Description of Artificial Sequence: Synthetic oligonucleotide
ugccgaguagcugggacua

SEQ ID NO: 2149 - RNA, 19 nt, Artificial Sequence
  Description of Artificial Sequence: Synthetic oligonucleotide
agucccagcuacucggcag

SEQ ID NO: 2150 - RNA, 19 nt, Artificial Sequence
  Description of Artificial Sequence: Synthetic oligonucleotide
cugccgaguagcugggacu

SEQ ID NO: 2151 - RNA, 19 nt, Artificial Sequence
  Description of Artificial Sequence: Synthetic oligonucleotide
gagcuugcagugagccgag

SEQ ID NO: 2152 - RNA, 19 nt, Artificial Sequence
  Description of Artificial Sequence: Synthetic oligonucleotide
cucggcucacugcaagcuc

SEQ ID NO: 2153 - RNA, 19 nt, Artificial Sequence
  Description of Artificial Sequence: Synthetic oligonucleotide
acugcauuccagccugggu

SEQ ID NO: 2154 - RNA, 19 nt, Artificial Sequence
  Description of Artificial Sequence: Synthetic oligonucleotide
acccaggcuggaaugcagu

SEQ ID NO: 2155 - RNA, 19 nt, Artificial Sequence
  Description of Artificial Sequence: Synthetic oligonucleotide
cugcauuccagccugggug

SEQ ID NO: 2156 - RNA, 19 nt, Artificial Sequence
  Description of Artificial Sequence: Synthetic oligonucleotide
cacccaggcuggaaugcag

SEQ ID NO: 2157 - RNA, 19 nt, Artificial Sequence
  Description of Artificial Sequence: Synthetic oligonucleotide
ugcauuccagccuggguga

SEQ ID NO: 2158 - RNA, 19 nt, Artificial Sequence
  Description of Artificial Sequence: Synthetic oligonucleotide
ucacccaggcuggaaugca

SEQ ID NO: 2159 - RNA, 19 nt, Artificial Sequence
  Description of Artificial Sequence: Synthetic oligonucleotide
gcauuccagccugggugac

SEQ ID NO: 2160 - RNA, 19 nt, Artificial Sequence
  Description of Artificial Sequence: Synthetic oligonucleotide
gucacccaggcuggaaugc

SEQ ID NO: 2161 - RNA, 19 nt, Artificial Sequence
  Description of Artificial Sequence: Synthetic oligonucleotide
cauuccagccugggugacu

SEQ ID NO: 2162 - RNA, 19 nt, Artificial Sequence
  Description of Artificial Sequence: Synthetic oligonucleotide
agucacccaggcuggaaug

SEQ ID NO: 2163 - RNA, 19 nt, Artificial Sequence
  Description of Artificial Sequence: Synthetic oligonucleotide
auuccagccugggugacug

SEQ ID NO: 2164 - RNA, 19 nt, Artificial Sequence
  Description of Artificial Sequence: Synthetic oligonucleotide
cagucacccaggcuggaau

SEQ ID NO: 2165 - RNA, 19 nt, Artificial Sequence
  Description of Artificial Sequence: Synthetic oligonucleotide
uuccagccugggugacuga

SEQ ID NO: 2166 - RNA, 19 nt, Artificial Sequence
  Description of Artificial Sequence: Synthetic oligonucleotide
ucagucacccaggcuggaa

SEQ ID NO: 2167 - RNA, 19 nt, Artificial Sequence
  Description of Artificial Sequence: Synthetic oligonucleotide
uccagccugggugacugag

SEQ ID NO: 2168 - RNA, 19 nt, Artificial Sequence
  Description of Artificial Sequence: Synthetic oligonucleotide
cucagucacccaggcugga

SEQ ID NO: 2169 - RNA, 19 nt, Artificial Sequence
  Description of Artificial Sequence: Synthetic oligonucleotide
aagguacaucagacaugac

SEQ ID NO: 2170 - RNA, 19 nt, Artificial Sequence
  Description of Artificial Sequence: Synthetic oligonucleotide
gucaugucugauguaccuu

SEQ ID NO: 2171 - RNA, 19 nt, Artificial Sequence
  Description of Artificial Sequence: Synthetic oligonucleotide
agguacaucagacaugacu

SEQ ID NO: 2172 - RNA, 19 nt, Artificial Sequence
  Description of Artificial Sequence: Synthetic oligonucleotide
agucaugucugauguaccu

SEQ ID NO: 2173 - RNA, 19 nt, Artificial Sequence
  Description of Artificial Sequence: Synthetic oligonucleotide
gguacaucagacaugacug

SEQ ID NO: 2174 - RNA, 19 nt, Artificial Sequence
  Description of Artificial Sequence: Synthetic oligonucleotide
cagucaugucugauguacc

SEQ ID NO: 2175 - RNA, 19 nt, Artificial Sequence
  Description of Artificial Sequence: Synthetic oligonucleotide
guacaucagacaugacugc

SEQ ID NO: 2176 - RNA, 19 nt, Artificial Sequence
  Description of Artificial Sequence: Synthetic oligonucleotide
gcagucaugucugauguac

SEQ ID NO: 2177 - RNA, 19 nt, Artificial Sequence
  Description of Artificial Sequence: Synthetic oligonucleotide
aucagacaugacugccugc

SEQ ID NO: 2178 - RNA, 19 nt, Artificial Sequence
  Description of Artificial Sequence: Synthetic oligonucleotide
gcaggcagucaugucugau

SEQ ID NO: 2179 - RNA, 19 nt, Artificial Sequence
  Description of Artificial Sequence: Synthetic oligonucleotide
ucagacaugacugccugca

SEQ ID NO: 2180 - RNA, 19 nt, Artificial Sequence
  Description of Artificial Sequence: Synthetic oligonucleotide
ugcaggcagucaugucuga

SEQ ID NO: 2181 - RNA, 19 nt, Artificial Sequence
  Description of Artificial Sequence: Synthetic oligonucleotide
cagacaugacugccugcau

SEQ ID NO: 2182 - RNA, 19 nt, Artificial Sequence
  Description of Artificial Sequence: Synthetic oligonucleotide
augcaggcagucaugucug

SEQ ID NO: 2183 - RNA, 19 nt, Artificial Sequence
  Description of Artificial Sequence: Synthetic oligonucleotide
augacugccugcaugaagu

SEQ ID NO: 2184 - RNA, 19 nt, Artificial Sequence
  Description of Artificial Sequence: Synthetic oligonucleotide
acuucaugcaggcagucau

SEQ ID NO: 2185 - RNA, 19 nt, Artificial Sequence
  Description of Artificial Sequence: Synthetic oligonucleotide
acugccugcaugaagucaa

SEQ ID NO: 2186 - RNA, 19 nt, Artificial Sequence
  Description of Artificial Sequence: Synthetic oligonucleotide
uugacuucaugcaggcagu

SEQ ID NO: 2187 - RNA, 19 nt, Artificial Sequence
  Description of Artificial Sequence: Synthetic oligonucleotide
cugccugcaugaagucaaa

SEQ ID NO: 2188 - RNA, 19 nt, Artificial Sequence
  Description of Artificial Sequence: Synthetic oligonucleotide
uuugacuucaugcaggcag

SEQ ID NO: 2189 - RNA, 19 nt, Artificial Sequence
  Description of Artificial Sequence: Synthetic oligonucleotide
acaccagugaagcucaagu

SEQ ID NO: 2190 - RNA, 19 nt, Artificial Sequence
  Description of Artificial Sequence: Synthetic oligonucleotide
acuugagcuucacuggugu

SEQ ID NO: 2191 - RNA, 19 nt, Artificial Sequence
  Description of Artificial Sequence: Synthetic oligonucleotide
caccagugaagcucaaguc

SEQ ID NO: 2192 - RNA, 19 nt, Artificial Sequence
  Description of Artificial Sequence: Synthetic oligonucleotide
gacuugagcuucacuggug

SEQ ID NO: 2193 - RNA, 19 nt, Artificial Sequence
  Description of Artificial Sequence: Synthetic oligonucleotide
accagugaagcucaaguca

SEQ ID NO: 2194 - RNA, 19 nt, Artificial Sequence
  Description of Artificial Sequence: Synthetic oligonucleotide
ugacuugagcuucacuggu

SEQ ID NO: 2195 - RNA, 19 nt, Artificial Sequence
  Description of Artificial Sequence: Synthetic oligonucleotide
gugaagcucaagucaagag

SEQ ID NO: 2196 - RNA, 19 nt, Artificial Sequence
  Description of Artificial Sequence: Synthetic oligonucleotide
cucuugacuugagcuucac

SEQ ID NO: 2197 - RNA, 19 nt, Artificial Sequence
  Description of Artificial Sequence: Synthetic oligonucleotide
cucaagucaagagcugugg

SEQ ID NO: 2198 - RNA, 19 nt, Artificial Sequence
  Description of Artificial Sequence: Synthetic oligonucleotide
ccacagcucuugacuugag

SEQ ID NO: 2199 - RNA, 19 nt, Artificial Sequence
  Description of Artificial Sequence: Synthetic oligonucleotide
ucaagucaagagcugugga

SEQ ID NO: 2200 - RNA, 19 nt, Artificial Sequence
  Description of Artificial Sequence: Synthetic oligonucleotide
uccacagcucuugacuuga

SEQ ID NO: 2201 - RNA, 19 nt, Artificial Sequence
  Description of Artificial Sequence: Synthetic oligonucleotide
caagucaagagcuguggau

SEQ ID NO: 2202 - RNA, 19 nt, Artificial Sequence
  Description of Artificial Sequence: Synthetic oligonucleotide
auccacagcucuugacuug

SEQ ID NO: 2203 - RNA, 19 nt, Artificial Sequence
  Description of Artificial Sequence: Synthetic oligonucleotide
aagucaagagcuguggaua

SEQ ID NO: 2204 - RNA, 19 nt, Artificial Sequence
  Description of Artificial Sequence: Synthetic oligonucleotide
uauccacagcucuugacuu

SEQ ID NO: 2205 - RNA, 19 nt, Artificial Sequence
  Description of Artificial Sequence: Synthetic oligonucleotide
agucaagagcuguggauau

SEQ ID NO: 2206 - RNA, 19 nt, Artificial Sequence
  Description of Artificial Sequence: Synthetic oligonucleotide
auauccacagcucuugacu

SEQ ID NO: 2207 - RNA, 19 nt, Artificial Sequence
  Description of Artificial Sequence: Synthetic oligonucleotide
gucaagagcuguggauauu

SEQ ID NO: 2208 - RNA, 19 nt, Artificial Sequence
  Description of Artificial Sequence: Synthetic oligonucleotide
aauauccacagcucuugac

SEQ ID NO: 2209 - RNA, 19 nt, Artificial Sequence
  Description of Artificial Sequence: Synthetic oligonucleotide
caagagcuguggauauuuu

SEQ ID NO: 2210 - RNA, 19 nt, Artificial Sequence
  Description of Artificial Sequence: Synthetic oligonucleotide
aaaauauccacagcucuug

SEQ ID NO: 2211 - RNA, 19 nt, Artificial Sequence
  Description of Artificial Sequence: Synthetic oligonucleotide
aagagcuguggauauuuug

SEQ ID NO: 2212 - RNA, 19 nt, Artificial Sequence
  Description of Artificial Sequence: Synthetic oligonucleotide
caaaauauccacagcucuu

SEQ ID NO: 2213 - RNA, 19 nt, Artificial Sequence
  Description of Artificial Sequence: Synthetic oligonucleotide
agagcuguggauauuuugu

SEQ ID NO: 2214 - RNA, 19 nt, Artificial Sequence
  Description of Artificial Sequence: Synthetic oligonucleotide
acaaaauauccacagcucu

SEQ ID NO: 2215 - RNA, 19 nt, Artificial Sequence
  Description of Artificial Sequence: Synthetic oligonucleotide
gagcuguggauauuuuguc

SEQ ID NO: 2216 - RNA, 19 nt, Artificial Sequence
  Description of Artificial Sequence: Synthetic oligonucleotide
gacaaaauauccacagcuc

SEQ ID NO: 2217 - RNA, 19 nt, Artificial Sequence
  Description of Artificial Sequence: Synthetic oligonucleotide
agcuguggauauuuugucu

SEQ ID NO: 2218 - RNA, 19 nt, Artificial Sequence
  Description of Artificial Sequence: Synthetic oligonucleotide
agacaaaauauccacagcu

SEQ ID NO: 2219 - RNA, 19 nt, Artificial Sequence
  Description of Artificial Sequence: Synthetic oligonucleotide
gcuguggauauuuugucua

SEQ ID NO: 2220 - RNA, 19 nt, Artificial Sequence
  Description of Artificial Sequence: Synthetic oligonucleotide
uagacaaaauauccacagc

SEQ ID NO: 2221 - RNA, 19 nt, Artificial Sequence
  Description of Artificial Sequence: Synthetic oligonucleotide
cuguggauauuuugucuaa

SEQ ID NO: 2222 - RNA, 19 nt, Artificial Sequence
  Description of Artificial Sequence: Synthetic oligonucleotide
uuagacaaaauauccacag

SEQ ID NO: 2223 - RNA, 19 nt, Artificial Sequence
  Description of Artificial Sequence: Synthetic oligonucleotide
uguggauauuuugucuaac

SEQ ID NO: 2224 - RNA, 19 nt, Artificial Sequence
  Description of Artificial Sequence: Synthetic oligonucleotide
guuagacaaaauauccaca

SEQ ID NO: 2225 - RNA, 19 nt, Artificial Sequence
  Description of Artificial Sequence: Synthetic oligonucleotide
guggauauuuugucuaacc

SEQ ID NO: 2226 - RNA, 19 nt, Artificial Sequence
  Description of Artificial Sequence: Synthetic oligonucleotide
gguuagacaaaauauccac

SEQ ID NO: 2227 - RNA, 19 nt, Artificial Sequence
  Description of Artificial Sequence: Synthetic oligonucleotide
uggauauuuugucuaacca

SEQ ID NO: 2228 - RNA, 19 nt, Artificial Sequence
  Description of Artificial Sequence: Synthetic oligonucleotide
ugguuagacaaaauaucca

SEQ ID NO: 2229 - RNA, 19 nt, Artificial Sequence
  Description of Artificial Sequence: Synthetic oligonucleotide
ggauauuuugucuaaccaa

SEQ ID NO: 2230 - RNA, 19 nt, Artificial Sequence
  Description of Artificial Sequence: Synthetic oligonucleotide
uugguuagacaaaauaucc

SEQ ID NO: 2231 - RNA, 19 nt, Artificial Sequence
  Description of Artificial Sequence: Synthetic oligonucleotide
ucguauccagccaaaagau

SEQ ID NO: 2232 - RNA, 19 nt, Artificial Sequence
  Description of Artificial Sequence: Synthetic oligonucleotide
aucuuuuggcuggauacga

SEQ ID NO: 2233 - RNA, 19 nt, Artificial Sequence
  Description of Artificial Sequence: Synthetic oligonucleotide
cguauccagccaaaagaug

SEQ ID NO: 2234 - RNA, 19 nt, Artificial Sequence
  Description of Artificial Sequence: Synthetic oligonucleotide
caucuuuuggcuggauacg

SEQ ID NO: 2235 - RNA, 19 nt, Artificial Sequence
  Description of Artificial Sequence: Synthetic oligonucleotide
guauccagccaaaagaugc

SEQ ID NO: 2236 - RNA, 19 nt, Artificial Sequence
  Description of Artificial Sequence: Synthetic oligonucleotide
gcaucuuuuggcuggauac

SEQ ID NO: 2237 - RNA, 19 nt, Artificial Sequence
  Description of Artificial Sequence: Synthetic oligonucleotide
uauccagccaaaagaugca

SEQ ID NO: 2238 - RNA, 19 nt, Artificial Sequence
  Description of Artificial Sequence: Synthetic oligonucleotide
ugcaucuuuuggcuggaua

SEQ ID NO: 2239 - RNA, 19 nt, Artificial Sequence
  Description of Artificial Sequence: Synthetic oligonucleotide
auccagccaaaagaugcau

SEQ ID NO: 2240 - RNA, 19 nt, Artificial Sequence
  Description of Artificial Sequence: Synthetic oligonucleotide
augcaucuuuuggcuggau

SEQ ID NO: 2241 - RNA, 19 nt, Artificial Sequence
  Description of Artificial Sequence: Synthetic oligonucleotide
agccaaaagaugcaugaug

SEQ ID NO: 2242 - RNA, 19 nt, Artificial Sequence
  Description of Artificial Sequence: Synthetic oligonucleotide
caucaugcaucuuuuggcu

SEQ ID NO: 2243 - RNA, 19 nt, Artificial Sequence
  Description of Artificial Sequence: Synthetic oligonucleotide
gccaaaagaugcaugauga

SEQ ID NO: 2244 - RNA, 19 nt, Artificial Sequence
  Description of Artificial Sequence: Synthetic oligonucleotide
ucaucaugcaucuuuuggc

SEQ ID NO: 2245 - RNA, 19 nt, Artificial Sequence
  Description of Artificial Sequence: Synthetic oligonucleotide
ccaaaagaugcaugaugau

SEQ ID NO: 2246 - RNA, 19 nt, Artificial Sequence
  Description of Artificial Sequence: Synthetic oligonucleotide
aucaucaugcaucuuuugg

SEQ ID NO: 2247 - RNA, 19 nt, Artificial Sequence
  Description of Artificial Sequence: Synthetic oligonucleotide
caaaagaugcaugaugaug

SEQ ID NO: 2248 - RNA, 19 nt, Artificial Sequence
  Description of Artificial Sequence: Synthetic oligonucleotide
caucaucaugcaucuuuug

SEQ ID NO: 2249 - RNA, 19 nt, Artificial Sequence
  Description of Artificial Sequence: Synthetic oligonucleotide
aaaagaugcaugaugaugg

SEQ ID NO: 2250 - RNA, 19 nt, Artificial Sequence
  Description of Artificial Sequence: Synthetic oligonucleotide
ccaucaucaugcaucuuuu

SEQ ID NO: 2251 - RNA, 19 nt, Artificial Sequence
  Description of Artificial Sequence: Synthetic oligonucleotide
aaagaugcaugaugaugga

SEQ ID NO: 2252 - RNA, 19 nt, Artificial Sequence
  Description of Artificial Sequence: Synthetic oligonucleotide
uccaucaucaugcaucuuu

SEQ ID NO: 2253 - RNA, 19 nt, Artificial Sequence
  Description of Artificial Sequence: Synthetic oligonucleotide
gcaugaugauggaguggug

SEQ ID NO: 2254 - RNA, 19 nt, Artificial Sequence
  Description of Artificial Sequence: Synthetic oligonucleotide
caccacuccaucaucaugc

SEQ ID NO: 2255 - RNA, 19 nt, Artificial Sequence
  Description of Artificial Sequence: Synthetic oligonucleotide
caugaugauggaguggugg

SEQ ID NO: 2256 - RNA, 19 nt, Artificial Sequence
  Description of Artificial Sequence: Synthetic oligonucleotide
ccaccacuccaucaucaug

SEQ ID NO: 2257 - RNA, 19 nt, Artificial Sequence
  Description of Artificial Sequence: Synthetic oligonucleotide
augaugauggagugguggg

SEQ ID NO: 2258 - RNA, 19 nt, Artificial Sequence
  Description of Artificial Sequence: Synthetic oligonucleotide
cccaccacuccaucaucau

SEQ ID NO: 2259 - RNA, 19 nt, Artificial Sequence
  Description of Artificial Sequence: Synthetic oligonucleotide
gggaaggccaguucaguau

SEQ ID NO: 2260 - RNA, 19 nt, Artificial Sequence
  Description of Artificial Sequence: Synthetic oligonucleotide
auacugaacuggccuuccc

SEQ ID NO: 2261 - RNA, 19 nt, Artificial Sequence
  Description of Artificial Sequence: Synthetic oligonucleotide
ggaaggccaguucaguauc

SEQ ID NO: 2262 - RNA, 19 nt, Artificial Sequence
  Description of Artificial Sequence: Synthetic oligonucleotide
gauacugaacuggccuucc

SEQ ID NO: 2263 - RNA, 19 nt, Artificial Sequence
  Description of Artificial Sequence: Synthetic oligonucleotide
gaaggccaguucaguaucc

SEQ ID NO: 2264 - RNA, 19 nt, Artificial Sequence
  Description of Artificial Sequence: Synthetic oligonucleotide
ggauacugaacuggccuuc

SEQ ID NO: 2265 - RNA, 19 nt, Artificial Sequence
  Description of Artificial Sequence: Synthetic oligonucleotide
aggccaguucaguauccua

SEQ ID NO: 2266 - RNA, 19 nt, Artificial Sequence
  Description of Artificial Sequence: Synthetic oligonucleotide
uaggauacugaacuggccu

SEQ ID NO: 2267 - RNA, 19 nt, Artificial Sequence
  Description of Artificial Sequence: Synthetic oligonucleotide
ggccaguucaguauccuau

SEQ ID NO: 2268 - RNA, 19 nt, Artificial Sequence
  Description of Artificial Sequence: Synthetic oligonucleotide
auaggauacugaacuggcc

SEQ ID NO: 2269 - RNA, 19 nt, Artificial Sequence
  Description of Artificial Sequence: Synthetic oligonucleotide
gccaguucaguauccuauu

SEQ ID NO: 2270 - RNA, 19 nt, Artificial Sequence
  Description of Artificial Sequence: Synthetic oligonucleotide
aauaggauacugaacuggc

SEQ ID NO: 2271 - RNA, 19 nt, Artificial Sequence
  Description of Artificial Sequence: Synthetic oligonucleotide
ccaguucaguauccuauuu

SEQ ID NO: 2272 - RNA, 19 nt, Artificial Sequence
  Description of Artificial Sequence: Synthetic oligonucleotide
aaauaggauacugaacugg

SEQ ID NO: 2273 - RNA, 19 nt, Artificial Sequence
  Description of Artificial Sequence: Synthetic oligonucleotide
caguucaguauccuauuua

SEQ ID NO: 2274 - RNA, 19 nt, Artificial Sequence
  Description of Artificial Sequence: Synthetic oligonucleotide
uaaauaggauacugaacug

SEQ ID NO: 2275 - RNA, 19 nt, Artificial Sequence
  Description of Artificial Sequence: Synthetic oligonucleotide
aacuuccugaauaauggau

SEQ ID NO: 2276 - RNA, 19 nt, Artificial Sequence
  Description of Artificial Sequence: Synthetic oligonucleotide
auccauuauucaggaaguu

SEQ ID NO: 2277 - RNA, 19 nt, Artificial Sequence
  Description of Artificial Sequence: Synthetic oligonucleotide
acuuccugaauaauggaua

SEQ ID NO: 2278 - RNA, 19 nt, Artificial Sequence
  Description of Artificial Sequence: Synthetic oligonucleotide
uauccauuauucaggaagu

SEQ ID NO: 2279 - RNA, 19 nt, Artificial Sequence
  Description of Artificial Sequence: Synthetic oligonucleotide
cuuccugaauaauggauau

SEQ ID NO: 2280 - RNA, 19 nt, Artificial Sequence
  Description of Artificial Sequence: Synthetic oligonucleotide
auauccauuauucaggaag

SEQ ID NO: 2281 - RNA, 19 nt, Artificial Sequence
  Description of Artificial Sequence: Synthetic oligonucleotide
gaauaauggauauaugugg

SEQ ID NO: 2282 - RNA, 19 nt, Artificial Sequence
  Description of Artificial Sequence: Synthetic oligonucleotide
ccacauauauccauuauuc

SEQ ID NO: 2283 - RNA, 19 nt, Artificial Sequence
  Description of Artificial Sequence: Synthetic oligonucleotide
auaauggauauauguggag

SEQ ID NO: 2284 - RNA, 19 nt, Artificial Sequence
  Description of Artificial Sequence: Synthetic oligonucleotide
cuccacauauauccauuau

SEQ ID NO: 2285 - RNA, 19 nt, Artificial Sequence
  Description of Artificial Sequence: Synthetic oligonucleotide
agauauauagauacagcug

SEQ ID NO: 2286 - RNA, 19 nt, Artificial Sequence
  Description of Artificial Sequence: Synthetic oligonucleotide
cagcuguaucuauauaucu

SEQ ID NO: 2287 - RNA, 19 nt, Artificial Sequence
  Description of Artificial Sequence: Synthetic oligonucleotide
gauauauagauacagcugu

SEQ ID NO: 2288 - RNA, 19 nt, Artificial Sequence
  Description of Artificial Sequence: Synthetic oligonucleotide
acagcuguaucuauauauc

SEQ ID NO: 2289 - RNA, 19 nt, Artificial Sequence
  Description of Artificial Sequence: Synthetic oligonucleotide
acagcuguaauuauuuagc

SEQ ID NO: 2290 - RNA, 19 nt, Artificial Sequence
  Description of Artificial Sequence: Synthetic oligonucleotide
gcuaaauaauuacagcugu

SEQ ID NO: 2291 - RNA, 19 nt, Artificial Sequence
  Description of Artificial Sequence: Synthetic oligonucleotide
cagcuguaauuauuuagcc

SEQ ID NO: 2292 - RNA, 19 nt, Artificial Sequence
  Description of Artificial Sequence: Synthetic oligonucleotide
ggcuaaauaauuacagcug

SEQ ID NO: 2293 - RNA, 19 nt, Artificial Sequence
  Description of Artificial Sequence: Synthetic oligonucleotide
agcuguaauuauuuagccu

SEQ ID NO: 2294 - RNA, 19 nt, Artificial Sequence
  Description of Artificial Sequence: Synthetic oligonucleotide
aggcuaaauaauuacagcu

SEQ ID NO: 2295 - RNA, 19 nt, Artificial Sequence
  Description of Artificial Sequence: Synthetic oligonucleotide
guaauuauuuagccucaag

SEQ ID NO: 2296 - RNA, 19 nt, Artificial Sequence
  Description of Artificial Sequence: Synthetic oligonucleotide
cuugaggcuaaauaauuac

SEQ ID NO: 2297 - RNA, 19 nt, Artificial Sequence
  Description of Artificial Sequence: Synthetic oligonucleotide
aauuauuuagccucaagug

SEQ ID NO: 2298 - RNA, 19 nt, Artificial Sequence
  Description of Artificial Sequence: Synthetic oligonucleotide
cacuugaggcuaaauaauu

SEQ ID NO: 2299 - RNA, 19 nt, Artificial Sequence
  Description of Artificial Sequence: Synthetic oligonucleotide
auuauuuagccucaaguga

SEQ ID NO: 2300 - RNA, 19 nt, Artificial Sequence
  Description of Artificial Sequence: Synthetic oligonucleotide
ucacuugaggcuaaauaau

SEQ ID NO: 2301 - RNA, 19 nt, Artificial Sequence
  Description of Artificial Sequence: Synthetic oligonucleotide
uuuagccucaagugacuuu

SEQ ID NO: 2302 - RNA, 19 nt, Artificial Sequence
  Description of Artificial Sequence: Synthetic oligonucleotide
aaagucacuugaggcuaaa

SEQ ID NO: 2303 - RNA, 19 nt, Artificial Sequence
  Description of Artificial Sequence: Synthetic oligonucleotide
aagugacuuucuccauugc

SEQ ID NO: 2304 - RNA, 19 nt, Artificial Sequence
  Description of Artificial Sequence: Synthetic oligonucleotide
gcaauggagaaagucacuu

SEQ ID NO: 2305 - RNA, 19 nt, Artificial Sequence
  Description of Artificial Sequence: Synthetic oligonucleotide
agugacuuucuccauugcu

SEQ ID NO: 2306 - RNA, 19 nt, Artificial Sequence
  Description of Artificial Sequence: Synthetic oligonucleotide
agcaauggagaaagucacu

SEQ ID NO: 2307 - RNA, 19 nt, Artificial Sequence
  Description of Artificial Sequence: Synthetic oligonucleotide
gugacuuucuccauugcuu

SEQ ID NO: 2308 - RNA, 19 nt, Artificial Sequence
  Description of Artificial Sequence: Synthetic oligonucleotide
aagcaauggagaaagucac

SEQ ID NO: 2309 - RNA, 19 nt, Artificial Sequence
  Description of Artificial Sequence: Synthetic oligonucleotide
uuucuccauugcuucacgc

SEQ ID NO: 2310 - RNA, 19 nt, Artificial Sequence
  Description of Artificial Sequence: Synthetic oligonucleotide
gcgugaagcaauggagaaa

SEQ ID NO: 2311 - RNA, 19 nt, Artificial Sequence
  Description of Artificial Sequence: Synthetic oligonucleotide
uucuccauugcuucacgcu

SEQ ID NO: 2312 - RNA, 19 nt, Artificial Sequence
  Description of Artificial Sequence: Synthetic oligonucleotide
agcgugaagcaauggagaa

SEQ ID NO: 2313 - RNA, 19 nt, Artificial Sequence
  Description of Artificial Sequence: Synthetic oligonucleotide
ucuccauugcuucacgcua

SEQ ID NO: 2314 - RNA, 19 nt, Artificial Sequence
  Description of Artificial Sequence: Synthetic oligonucleotide
uagcgugaagcaauggaga

SEQ ID NO: 2315 - RNA, 19 nt, Artificial Sequence
  Description of Artificial Sequence: Synthetic oligonucleotide
cuccauugcuucacgcuau

SEQ ID NO: 2316 - RNA, 19 nt, Artificial Sequence
  Description of Artificial Sequence: Synthetic oligonucleotide
auagcgugaagcaauggag

SEQ ID NO: 2317 - RNA, 19 nt, Artificial Sequence
  Description of Artificial Sequence: Synthetic oligonucleotide
uccauugcuucacgcuaug

SEQ ID NO: 2318 - RNA, 19 nt, Artificial Sequence
  Description of Artificial Sequence: Synthetic oligonucleotide
cauagcgugaagcaaugga

SEQ ID NO: 2319 - RNA, 19 nt, Artificial Sequence
  Description of Artificial Sequence: Synthetic oligonucleotide
ccauugcuucacgcuaugc

SEQ ID NO: 2320 - RNA, 19 nt, Artificial Sequence
  Description of Artificial Sequence: Synthetic oligonucleotide
gcauagcgugaagcaaugg

SEQ ID NO: 2321 - RNA, 19 nt, Artificial Sequence
  Description of Artificial Sequence: Synthetic oligonucleotide
cauugcuucacgcuaugcc

SEQ ID NO: 2322 - RNA, 19 nt, Artificial Sequence
  Description of Artificial Sequence: Synthetic oligonucleotide
ggcauagcgugaagcaaug

SEQ ID NO: 2323 - RNA, 19 nt, Artificial Sequence
  Description of Artificial Sequence: Synthetic oligonucleotide
auugcuucacgcuaugcca

SEQ ID NO: 2324 - RNA, 19 nt, Artificial Sequence
  Description of Artificial Sequence: Synthetic oligonucleotide
uggcauagcgugaagcaau

SEQ ID NO: 2325 - RNA, 19 nt, Artificial Sequence
  Description of Artificial Sequence: Synthetic oligonucleotide
uugcuucacgcuaugccac

SEQ ID NO: 2326 - RNA, 19 nt, Artificial Sequence
  Description of Artificial Sequence: Synthetic oligonucleotide
guggcauagcgugaagcaa

SEQ ID NO: 2327 - RNA, 19 nt, Artificial Sequence
  Description of Artificial Sequence: Synthetic oligonucleotide
ugcuucacgcuaugccacu

SEQ ID NO: 2328 - RNA, 19 nt, Artificial Sequence
  Description of Artificial Sequence: Synthetic oligonucleotide
aguggcauagcgugaagca

SEQ ID NO: 2329 - RNA, 19 nt, Artificial Sequence
  Description of Artificial Sequence: Synthetic oligonucleotide
gcuucacgcuaugccacua

SEQ ID NO: 2330 - RNA, 19 nt, Artificial Sequence
  Description of Artificial Sequence: Synthetic oligonucleotide
uaguggcauagcgugaagc

SEQ ID NO: 2331 - RNA, 19 nt, Artificial Sequence
  Description of Artificial Sequence: Synthetic oligonucleotide
cuucacgcuaugccacuau

SEQ ID NO: 2332 - RNA, 19 nt, Artificial Sequence
  Description of Artificial Sequence: Synthetic oligonucleotide
auaguggcauagcgugaag

SEQ ID NO: 2333 - RNA, 19 nt, Artificial Sequence
  Description of Artificial Sequence: Synthetic oligonucleotide
uucacgcuaugccacuauu

SEQ ID NO: 2334 - RNA, 19 nt, Artificial Sequence
  Description of Artificial Sequence: Synthetic oligonucleotide
aauaguggcauagcgugaa

SEQ ID NO: 2335 - RNA, 19 nt, Artificial Sequence
  Description of Artificial Sequence: Synthetic oligonucleotide
ucacgcuaugccacuauuu

SEQ ID NO: 2336 - RNA, 19 nt, Artificial Sequence
  Description of Artificial Sequence: Synthetic oligonucleotide
aaauaguggcauagcguga

SEQ ID NO: 2337 - RNA, 19 nt, Artificial Sequence
  Description of Artificial Sequence: Synthetic oligonucleotide
cacgcuaugccacuauuuu

SEQ ID NO: 2338 - RNA, 19 nt, Artificial Sequence
  Description of Artificial Sequence: Synthetic oligonucleotide
aaaauaguggcauagcgug

SEQ ID NO: 2339 - RNA, 19 nt, Artificial Sequence
  Description of Artificial Sequence: Synthetic oligonucleotide
cgcuaugccacuauuuugc

SEQ ID NO: 2340 - RNA, 19 nt, Artificial Sequence
  Description of Artificial Sequence: Synthetic oligonucleotide
gcaaaauaguggcauagcg

SEQ ID NO: 2341 - RNA, 19 nt, Artificial Sequence
  Description of Artificial Sequence: Synthetic oligonucleotide
gcuaugccacuauuuugcu

SEQ ID NO: 2342 - RNA, 19 nt, Artificial Sequence
  Description of Artificial Sequence: Synthetic oligonucleotide
agcaaaauaguggcauagc

SEQ ID NO: 2343 - RNA, 19 nt, Artificial Sequence
  Description of Artificial Sequence: Synthetic oligonucleotide
cuaugccacuauuuugcuu

SEQ ID NO: 2344 - RNA, 19 nt, Artificial Sequence
  Description of Artificial Sequence: Synthetic oligonucleotide
aagcaaaauaguggcauag

SEQ ID NO: 2345 - RNA, 19 nt, Artificial Sequence
  Description of Artificial Sequence: Synthetic oligonucleotide
uaugccacuauuuugcuuc

SEQ ID NO: 2346 - RNA, 19 nt, Artificial Sequence
  Description of Artificial Sequence: Synthetic oligonucleotide
gaagcaaaauaguggcaua

SEQ ID NO: 2347 - RNA, 19 nt, Artificial Sequence
  Description of Artificial Sequence: Synthetic oligonucleotide
augccacuauuuugcuucu

SEQ ID NO: 2348 - RNA, 19 nt, Artificial Sequence
  Description of Artificial Sequence: Synthetic oligonucleotide
agaagcaaaauaguggcau

SEQ ID NO: 2349 - RNA, 19 nt, Artificial Sequence
  Description of Artificial Sequence: Synthetic oligonucleotide
ugccacuauuuugcuucuu

SEQ ID NO: 2350 - RNA, 19 nt, Artificial Sequence
  Description of Artificial Sequence: Synthetic oligonucleotide
aagaagcaaaauaguggca

SEQ ID NO: 2351 - RNA, 19 nt, Artificial Sequence
  Description of Artificial Sequence: Synthetic oligonucleotide
aaccuugcuuaguauucua

SEQ ID NO: 2352 - RNA, 19 nt, Artificial Sequence
  Description of Artificial Sequence: Synthetic oligonucleotide
uagaauacuaagcaagguu

SEQ ID NO: 2353 - RNA, 19 nt, Artificial Sequence
  Description of Artificial Sequence: Synthetic oligonucleotide
ccuugcuuaguauucuaua

SEQ ID NO: 2354 - RNA, 19 nt, Artificial Sequence
  Description of Artificial Sequence: Synthetic oligonucleotide
uauagaauacuaagcaagg

SEQ ID NO: 2355 - RNA, 19 nt, Artificial Sequence
  Description of Artificial Sequence: Synthetic oligonucleotide
aguauucuauaguuugccc

SEQ ID NO: 2356 - RNA, 19 nt, Artificial Sequence
  Description of Artificial Sequence: Synthetic oligonucleotide
gggcaaacuauagaauacu

SEQ ID NO: 2357 - RNA, 19 nt, Artificial Sequence
  Description of Artificial Sequence: Synthetic oligonucleotide
guauucuauaguuugccca

SEQ ID NO: 2358 - RNA, 19 nt, Artificial Sequence
  Description of Artificial Sequence: Synthetic oligonucleotide
ugggcaaacuauagaauac

SEQ ID NO: 2359 - RNA, 19 nt, Artificial Sequence
  Description of Artificial Sequence: Synthetic oligonucleotide
uauucuauaguuugcccaa

SEQ ID NO: 2360 - RNA, 19 nt, Artificial Sequence
  Description of Artificial Sequence: Synthetic oligonucleotide
uugggcaaacuauagaaua

SEQ ID NO: 2361 - RNA, 19 nt, Artificial Sequence
  Description of Artificial Sequence: Synthetic oligonucleotide
auucuauaguuugcccaac

SEQ ID NO: 2362 - RNA, 19 nt, Artificial Sequence
  Description of Artificial Sequence: Synthetic oligonucleotide
guugggcaaacuauagaau

SEQ ID NO: 2363 - RNA, 19 nt, Artificial Sequence
  Description of Artificial Sequence: Synthetic oligonucleotide
uauaguuugcccaaccagu

SEQ ID NO: 2364 - RNA, 19 nt, Artificial Sequence
  Description of Artificial Sequence: Synthetic oligonucleotide
acugguugggcaaacuaua

SEQ ID NO: 2365 - RNA, 19 nt, Artificial Sequence
  Description of Artificial Sequence: Synthetic oligonucleotide
auaguuugcccaaccaguu

SEQ ID NO: 2366 - RNA, 19 nt, Artificial Sequence
  Description of Artificial Sequence: Synthetic oligonucleotide
aacugguugggcaaacuau

SEQ ID NO: 2367 - RNA, 19 nt, Artificial Sequence
  Description of Artificial Sequence: Synthetic oligonucleotide
uaguuugcccaaccaguuu

SEQ ID NO: 2368 - RNA, 19 nt, Artificial Sequence
  Description of Artificial Sequence: Synthetic oligonucleotide
aaacugguugggcaaacua

SEQ ID NO: 2369 - RNA, 19 nt, Artificial Sequence
  Description of Artificial Sequence: Synthetic oligonucleotide
aguuugcccaaccaguuuu

SEQ ID NO: 2370 - RNA, 19 nt, Artificial Sequence
  Description of Artificial Sequence: Synthetic oligonucleotide
aaaacugguugggcaaacu

SEQ ID NO: 2371 - RNA, 19 nt, Artificial Sequence
  Description of Artificial Sequence: Synthetic oligonucleotide
guuugcccaaccaguuuua

SEQ ID NO: 2372 - RNA, 19 nt, Artificial Sequence
  Description of Artificial Sequence: Synthetic oligonucleotide
uaaaacugguugggcaaac

SEQ ID NO: 2373 - RNA, 19 nt, Artificial Sequence
  Description of Artificial Sequence: Synthetic oligonucleotide
uuugcccaaccaguuuuac

SEQ ID NO: 2374 - RNA, 19 nt, Artificial Sequence
  Description of Artificial Sequence: Synthetic oligonucleotide
guaaaacugguugggcaaa

SEQ ID NO: 2375 - RNA, 19 nt, Artificial Sequence
  Description of Artificial Sequence: Synthetic oligonucleotide
uugcccaaccaguuuuacg

SEQ ID NO: 2376 - RNA, 19 nt, Artificial Sequence
  Description of Artificial Sequence: Synthetic oligonucleotide
cguaaaacugguugggcaa

SEQ ID NO: 2377 - RNA, 19 nt, Artificial Sequence
  Description of Artificial Sequence: Synthetic oligonucleotide
ugcccaaccaguuuuacgu

SEQ ID NO: 2378 - RNA, 19 nt, Artificial Sequence
  Description of Artificial Sequence: Synthetic oligonucleotide
acguaaaacugguugggca

SEQ ID NO: 2379 - RNA, 19 nt, Artificial Sequence
  Description of Artificial Sequence: Synthetic oligonucleotide
gcccaaccaguuuuacguc

SEQ ID NO: 2380 - RNA, 19 nt, Artificial Sequence
  Description of Artificial Sequence: Synthetic oligonucleotide
gacguaaaacugguugggc

SEQ ID NO: 2381 - RNA, 19 nt, Artificial Sequence
  Description of Artificial Sequence: Synthetic oligonucleotide
cccaaccaguuuuacgucc

SEQ ID NO: 2382 - RNA, 19 nt, Artificial Sequence
  Description of Artificial Sequence: Synthetic oligonucleotide
ggacguaaaacugguuggg

SEQ ID NO: 2383 - RNA, 19 nt, Artificial Sequence
  Description of Artificial Sequence: Synthetic oligonucleotide
ccaaccaguuuuacgucca

SEQ ID NO: 2384 - RNA, 19 nt, Artificial Sequence
  Description of Artificial Sequence: Synthetic oligonucleotide
uggacguaaaacugguugg

SEQ ID NO: 2385 - RNA, 19 nt, Artificial Sequence
  Description of Artificial Sequence: Synthetic oligonucleotide
caaccaguuuuacguccaa

SEQ ID NO: 2386 - RNA, 19 nt, Artificial Sequence
  Description of Artificial Sequence: Synthetic oligonucleotide
uuggacguaaaacugguug

SEQ ID NO: 2387 - RNA, 19 nt, Artificial Sequence
  Description of Artificial Sequence: Synthetic oligonucleotide
aaccaguuuuacguccaag

SEQ ID NO: 2388 - RNA, 19 nt, Artificial Sequence
  Description of Artificial Sequence: Synthetic oligonucleotide
cuuggacguaaaacugguu

SEQ ID NO: 2389 - RNA, 19 nt, Artificial Sequence
  Description of Artificial Sequence: Synthetic oligonucleotide
gccaaugcauaaaauauac

SEQ ID NO: 2390 - RNA, 19 nt, Artificial Sequence
  Description of Artificial Sequence: Synthetic oligonucleotide
guauauuuuaugcauuggc

SEQ ID NO: 2391 - RNA, 19 nt, Artificial Sequence
  Description of Artificial Sequence: Synthetic oligonucleotide
aacuaggugucaggguuua

SEQ ID NO: 2392 - RNA, 19 nt, Artificial Sequence
  Description of Artificial Sequence: Synthetic oligonucleotide
uaaacccugacaccuaguu

SEQ ID NO: 2393 - RNA, 19 nt, Artificial Sequence
  Description of Artificial Sequence: Synthetic oligonucleotide
acuaggugucaggguuuau

SEQ ID NO: 2394 - RNA, 19 nt, Artificial Sequence
  Description of Artificial Sequence: Synthetic oligonucleotide
auaaacccugacaccuagu

SEQ ID NO: 2395 - RNA, 19 nt, Artificial Sequence
  Description of Artificial Sequence: Synthetic oligonucleotide
cuaggugucaggguuuauc

SEQ ID NO: 2396 - RNA, 19 nt, Artificial Sequence
  Description of Artificial Sequence: Synthetic oligonucleotide
gauaaacccugacaccuag

SEQ ID NO: 2397 - RNA, 19 nt, Artificial Sequence
  Description of Artificial Sequence: Synthetic oligonucleotide
uaggugucaggguuuauca

SEQ ID NO: 2398 - RNA, 19 nt, Artificial Sequence
  Description of Artificial Sequence: Synthetic oligonucleotide
ugauaaacccugacaccua

SEQ ID NO: 2399 - RNA, 19 nt, Artificial Sequence
  Description of Artificial Sequence: Synthetic oligonucleotide
aggugucaggguuuaucaa

SEQ ID NO: 2400 - RNA, 19 nt, Artificial Sequence
  Description of Artificial Sequence: Synthetic oligonucleotide
uugauaaacccugacaccu

SEQ ID NO: 2401 - RNA, 19 nt, Artificial Sequence
  Description of Artificial Sequence: Synthetic oligonucleotide
ggugucaggguuuaucaag

SEQ ID NO: 2402 - RNA, 19 nt, Artificial Sequence
  Description of Artificial Sequence: Synthetic oligonucleotide
cuugauaaacccugacacc

SEQ ID NO: 2403 - RNA, 19 nt, Artificial Sequence
  Description of Artificial Sequence: Synthetic oligonucleotide
gugucaggguuuaucaaga

SEQ ID NO: 2404 - RNA, 19 nt, Artificial Sequence
  Description of Artificial Sequence: Synthetic oligonucleotide
ucuugauaaacccugacac

SEQ ID NO: 2405 - RNA, 19 nt, Artificial Sequence
  Description of Artificial Sequence: Synthetic oligonucleotide
ugucaggguuuaucaagaa

SEQ ID NO: 2406 - RNA, 19 nt, Artificial Sequence
  Description of Artificial Sequence: Synthetic oligonucleotide
uucuugauaaacccugaca

SEQ ID NO: 2407 - RNA, 19 nt, Artificial Sequence
  Description of Artificial Sequence: Synthetic oligonucleotide
gucaggguuuaucaagaag

SEQ ID NO: 2408 - RNA, 19 nt, Artificial Sequence
  Description of Artificial Sequence: Synthetic oligonucleotide
cuucuugauaaacccugac

SEQ ID NO: 2409 - RNA, 19 nt, Artificial Sequence
  Description of Artificial Sequence: Synthetic oligonucleotide
gguuuaucaagaaggccag

SEQ ID NO: 2410 - RNA, 19 nt, Artificial Sequence
  Description of Artificial Sequence: Synthetic oligonucleotide
cuggccuucuugauaaacc

SEQ ID NO: 2411 - RNA, 19 nt, Artificial Sequence
  Description of Artificial Sequence: Synthetic oligonucleotide
uaucaagaaggccaggaag

SEQ ID NO: 2412 - RNA, 19 nt, Artificial Sequence
  Description of Artificial Sequence: Synthetic oligonucleotide
cuuccuggccuucuugaua

SEQ ID NO: 2413 - RNA, 19 nt, Artificial Sequence
  Description of Artificial Sequence: Synthetic oligonucleotide
ucaagaaggccaggaaggc

SEQ ID NO: 2414 - RNA, 19 nt, Artificial Sequence
  Description of Artificial Sequence: Synthetic oligonucleotide
gccuuccuggccuucuuga

SEQ ID NO: 2415 - RNA, 19 nt, Artificial Sequence
  Description of Artificial Sequence: Synthetic oligonucleotide
gccaggaaggccuuuuggg

SEQ ID NO: 2416 - RNA, 19 nt, Artificial Sequence
  Description of Artificial Sequence: Synthetic oligonucleotide
cccaaaaggccuuccuggc

SEQ ID NO: 2417 - RNA, 19 nt, Artificial Sequence
  Description of Artificial Sequence: Synthetic oligonucleotide
ccaggaaggccuuuugggu

SEQ ID NO: 2418 - RNA, 19 nt, Artificial Sequence
  Description of Artificial Sequence: Synthetic oligonucleotide
acccaaaaggccuuccugg

SEQ ID NO: 2419 - RNA, 19 nt, Artificial Sequence
  Description of Artificial Sequence: Synthetic oligonucleotide
caggaaggccuuuuggguu

SEQ ID NO: 2420 - RNA, 19 nt, Artificial Sequence
  Description of Artificial Sequence: Synthetic oligonucleotide
aacccaaaaggccuuccug

SEQ ID NO: 2421 - RNA, 19 nt, Artificial Sequence
  Description of Artificial Sequence: Synthetic oligonucleotide
aggaaggccuuuuggguua

SEQ ID NO: 2422 - RNA, 19 nt, Artificial Sequence
  Description of Artificial Sequence: Synthetic oligonucleotide
uaacccaaaaggccuuccu

SEQ ID NO: 2423 - RNA, 19 nt, Artificial Sequence
  Description of Artificial Sequence: Synthetic oligonucleotide
ggaaggccuuuuggguuaa

SEQ ID NO: 2424 - RNA, 19 nt, Artificial Sequence
  Description of Artificial Sequence: Synthetic oligonucleotide
uuaacccaaaaggccuucc

SEQ ID NO: 2425 - RNA, 19 nt, Artificial Sequence
  Description of Artificial Sequence: Synthetic oligonucleotide
gaaggccuuuuggguuaag

SEQ ID NO: 2426 - RNA, 19 nt, Artificial Sequence
  Description of Artificial Sequence: Synthetic oligonucleotide
cuuaacccaaaaggccuuc

SEQ ID NO: 2427 - RNA, 19 nt, Artificial Sequence
  Description of Artificial Sequence: Synthetic oligonucleotide
aaggccuuuuggguuaagc

SEQ ID NO: 2428 - RNA, 19 nt, Artificial Sequence
  Description of Artificial Sequence: Synthetic oligonucleotide
gcuuaacccaaaaggccuu

SEQ ID NO: 2429 - RNA, 19 nt, Artificial Sequence
  Description of Artificial Sequence: Synthetic oligonucleotide
aggccuuuuggguuaagcc

SEQ ID NO: 2430 - RNA, 19 nt, Artificial Sequence
  Description of Artificial Sequence: Synthetic oligonucleotide
ggcuuaacccaaaaggccu

SEQ ID NO: 2431 - RNA, 19 nt, Artificial Sequence
  Description of Artificial Sequence: Synthetic oligonucleotide
ggccuuuuggguuaagccu

SEQ ID NO: 2432 - RNA, 19 nt, Artificial Sequence
  Description of Artificial Sequence: Synthetic oligonucleotide
aggcuuaacccaaaaggcc

SEQ ID NO: 2433 - RNA, 19 nt, Artificial Sequence
  Description of Artificial Sequence: Synthetic oligonucleotide
uuccaaaugaauggucucu

SEQ ID NO: 2434 - RNA, 19 nt, Artificial Sequence
  Description of Artificial Sequence: Synthetic oligonucleotide
agagaccauucauuuggaa

SEQ ID NO: 2435 - RNA, 19 nt, Artificial Sequence
  Description of Artificial Sequence: Synthetic oligonucleotide
uccaaaugaauggucucug

SEQ ID NO: 2436 - RNA, 19 nt, Artificial Sequence
  Description of Artificial Sequence: Synthetic oligonucleotide
cagagaccauucauuugga

SEQ ID NO: 2437 - RNA, 19 nt, Artificial Sequence
  Description of Artificial Sequence: Synthetic oligonucleotide
ccaaaugaauggucucugg

SEQ ID NO: 2438 - RNA, 19 nt, Artificial Sequence
  Description of Artificial Sequence: Synthetic oligonucleotide
ccagagaccauucauuugg

SEQ ID NO: 2439 - RNA, 19 nt, Artificial Sequence
  Description of Artificial Sequence: Synthetic oligonucleotide
caaaugaauggucucuggu

SEQ ID NO: 2440 - RNA, 19 nt, Artificial Sequence
  Description of Artificial Sequence: Synthetic oligonucleotide
accagagaccauucauuug

SEQ ID NO: 2441 - RNA, 19 nt, Artificial Sequence
  Description of Artificial Sequence: Synthetic oligonucleotide
aaaugaauggucucugguc

SEQ ID NO: 2442 - RNA, 19 nt, Artificial Sequence
  Description of Artificial Sequence: Synthetic oligonucleotide
gaccagagaccauucauuu

SEQ ID NO: 2443 - RNA, 19 nt, Artificial Sequence
  Description of Artificial Sequence: Synthetic oligonucleotide
aaugaauggucucugguca

SEQ ID NO: 2444 - RNA, 19 nt, Artificial Sequence
  Description of Artificial Sequence: Synthetic oligonucleotide
ugaccagagaccauucauu

SEQ ID NO: 2445 - RNA, 19 nt, Artificial Sequence
  Description of Artificial Sequence: Synthetic oligonucleotide
augaauggucucuggucaa

SEQ ID NO: 2446 - RNA, 19 nt, Artificial Sequence
  Description of Artificial Sequence: Synthetic oligonucleotide
uugaccagagaccauucau

SEQ ID NO: 2447 - RNA, 19 nt, Artificial Sequence
  Description of Artificial Sequence: Synthetic oligonucleotide
ugaauggucucuggucaaa

SEQ ID NO: 2448 - RNA, 19 nt, Artificial Sequence
  Description of Artificial Sequence: Synthetic oligonucleotide
uuugaccagagaccauuca

SEQ ID NO: 2449 - RNA, 19 nt, Artificial Sequence
  Description of Artificial Sequence: Synthetic oligonucleotide
gaauggucucuggucaaau

SEQ ID NO: 2450 - RNA, 19 nt, Artificial Sequence
  Description of Artificial Sequence: Synthetic oligonucleotide
auuugaccagagaccauuc

SEQ ID NO: 2451 - RNA, 19 nt, Artificial Sequence
  Description of Artificial Sequence: Synthetic oligonucleotide
aauggucucuggucaaaug

SEQ ID NO: 2452 - RNA, 19 nt, Artificial Sequence
  Description of Artificial Sequence: Synthetic oligonucleotide
cauuugaccagagaccauu

SEQ ID NO: 2453 - RNA, 19 nt, Artificial Sequence
  Description of Artificial Sequence: Synthetic oligonucleotide
gucaaaugaaugaaugguc

SEQ ID NO: 2454 - RNA, 19 nt, Artificial Sequence
  Description of Artificial Sequence: Synthetic oligonucleotide
gaccauucauucauuugac

SEQ ID NO: 2455 - RNA, 19 nt, Artificial Sequence
  Description of Artificial Sequence: Synthetic oligonucleotide
ucaaaugaaugaaugguca

SEQ ID NO: 2456 - RNA, 19 nt, Artificial Sequence
  Description of Artificial Sequence: Synthetic oligonucleotide
ugaccauucauucauuuga

SEQ ID NO: 2457 - RNA, 19 nt, Artificial Sequence
  Description of Artificial Sequence: Synthetic oligonucleotide
caaaugaaugaauggucaa

SEQ ID NO: 2458 - RNA, 19 nt, Artificial Sequence
  Description of Artificial Sequence: Synthetic oligonucleotide
uugaccauucauucauuug

SEQ ID NO: 2459 - RNA, 19 nt, Artificial Sequence
  Description of Artificial Sequence: Synthetic oligonucleotide
augaaugaauggucaaaug

SEQ ID NO: 2460 - RNA, 19 nt, Artificial Sequence
  Description of Artificial Sequence: Synthetic oligonucleotide
cauuugaccauucauucau

SEQ ID NO: 2461 - RNA, 19 nt, Artificial Sequence
  Description of Artificial Sequence: Synthetic oligonucleotide
ggucaaaugaauaaaucug

SEQ ID NO: 2462 - RNA, 19 nt, Artificial Sequence
  Description of Artificial Sequence: Synthetic oligonucleotide
cagauuuauucauuugacc

SEQ ID NO: 2463 - RNA, 19 nt, Artificial Sequence
  Description of Artificial Sequence: Synthetic oligonucleotide
gucaaaugaauaaaucugc

SEQ ID NO: 2464 - RNA, 19 nt, Artificial Sequence
  Description of Artificial Sequence: Synthetic oligonucleotide
gcagauuuauucauuugac

SEQ ID NO: 2465 - RNA, 19 nt, Artificial Sequence
  Description of Artificial Sequence: Synthetic oligonucleotide
ucaaaugaauaaaucugcc

SEQ ID NO: 2466 - RNA, 19 nt, Artificial Sequence
  Description of Artificial Sequence: Synthetic oligonucleotide
ggcagauuuauucauuuga

SEQ ID NO: 2467 - RNA, 19 nt, Artificial Sequence
  Description of Artificial Sequence: Synthetic oligonucleotide
caaaugaauaaaucugccc

SEQ ID NO: 2468 - RNA, 19 nt, Artificial Sequence
  Description of Artificial Sequence: Synthetic oligonucleotide
gggcagauuuauucauuug

SEQ ID NO: 2469 - RNA, 19 nt, Artificial Sequence
  Description of Artificial Sequence: Synthetic oligonucleotide
aaaugaauaaaucugcccu

SEQ ID NO: 2470 - RNA, 19 nt, Artificial Sequence
  Description of Artificial Sequence: Synthetic oligonucleotide
agggcagauuuauucauuu

SEQ ID NO: 2471 - RNA, 19 nt, Artificial Sequence
  Description of Artificial Sequence: Synthetic oligonucleotide
aaugaauaaaucugcccuc

SEQ ID NO: 2472 - RNA, 19 nt, Artificial Sequence
  Description of Artificial Sequence: Synthetic oligonucleotide
gagggcagauuuauucauu

SEQ ID NO: 2473 - RNA, 19 nt, Artificial Sequence
  Description of Artificial Sequence: Synthetic oligonucleotide
augaauaaaucugcccuca

SEQ ID NO: 2474 - RNA, 19 nt, Artificial Sequence
  Description of Artificial Sequence: Synthetic oligonucleotide
ugagggcagauuuauucau

SEQ ID NO: 2475 - RNA, 19 nt, Artificial Sequence
  Description of Artificial Sequence: Synthetic oligonucleotide
gaauaaaucugcccucaca

SEQ ID NO: 2476 - RNA, 19 nt, Artificial Sequence
  Description of Artificial Sequence: Synthetic oligonucleotide
ugugagggcagauuuauuc

SEQ ID NO: 2477 - RNA, 19 nt, Artificial Sequence
  Description of Artificial Sequence: Synthetic oligonucleotide
aauaaaucugcccucacag

SEQ ID NO: 2478 - RNA, 19 nt, Artificial Sequence
  Description of Artificial Sequence: Synthetic oligonucleotide
cugugagggcagauuuauu

SEQ ID NO: 2479 - RNA, 19 nt, Artificial Sequence
  Description of Artificial Sequence: Synthetic oligonucleotide
ucauaccauuugguuuaag

SEQ ID NO: 2480 - RNA, 19 nt, Artificial Sequence
  Description of Artificial Sequence: Synthetic oligonucleotide
cuuaaaccaaaugguauga

SEQ ID NO: 2481 - RNA, 19 nt, Artificial Sequence
  Description of Artificial Sequence: Synthetic oligonucleotide
auaccauuugguuuaagcc

SEQ ID NO: 2482 - RNA, 19 nt, Artificial Sequence
  Description of Artificial Sequence: Synthetic oligonucleotide
ggcuuaaaccaaaugguau

SEQ ID NO: 2483 - RNA, 19 nt, Artificial Sequence
  Description of Artificial Sequence: Synthetic oligonucleotide
uaccauuugguuuaagccu

SEQ ID NO: 2484 - RNA, 19 nt, Artificial Sequence
  Description of Artificial Sequence: Synthetic oligonucleotide
aggcuuaaaccaaauggua

SEQ ID NO: 2485 - RNA, 19 nt, Artificial Sequence
  Description of Artificial Sequence: Synthetic oligonucleotide
accauuugguuuaagccuu

SEQ ID NO: 2486 - RNA, 19 nt, Artificial Sequence
  Description of Artificial Sequence: Synthetic oligonucleotide
aaggcuuaaaccaaauggu

SEQ ID NO: 2487 - RNA, 19 nt, Artificial Sequence
  Description of Artificial Sequence: Synthetic oligonucleotide
ccauuugguuuaagccuua

SEQ ID NO: 2488 - RNA, 19 nt, Artificial Sequence
  Description of Artificial Sequence: Synthetic oligonucleotide
uaaggcuuaaaccaaaugg

SEQ ID NO: 2489 - RNA, 19 nt, Artificial Sequence
  Description of Artificial Sequence: Synthetic oligonucleotide
cauuugguuuaagccuuac

SEQ ID NO: 2490 - RNA, 19 nt, Artificial Sequence
  Description of Artificial Sequence: Synthetic oligonucleotide
guaaggcuuaaaccaaaug

SEQ ID NO: 2491 - RNA, 19 nt, Artificial Sequence
  Description of Artificial Sequence: Synthetic oligonucleotide
auuugguuuaagccuuaca

SEQ ID NO: 2492 - RNA, 19 nt, Artificial Sequence
  Description of Artificial Sequence: Synthetic oligonucleotide
uguaaggcuuaaaccaaau

SEQ ID NO: 2493 - RNA, 19 nt, Artificial Sequence
  Description of Artificial Sequence: Synthetic oligonucleotide
guuuaagccuuacauucau

SEQ ID NO: 2494 - RNA, 19 nt, Artificial Sequence
  Description of Artificial Sequence: Synthetic oligonucleotide
augaauguaaggcuuaaac

SEQ ID NO: 2495 - RNA, 19 nt, Artificial Sequence
  Description of Artificial Sequence: Synthetic oligonucleotide
uuuaagccuuacauucaug

SEQ ID NO: 2496 - RNA, 19 nt, Artificial Sequence
  Description of Artificial Sequence: Synthetic oligonucleotide
caugaauguaaggcuuaaa

SEQ ID NO: 2497 - RNA, 19 nt, Artificial Sequence
  Description of Artificial Sequence: Synthetic oligonucleotide
uuccaaaugaagucgaauc

SEQ ID NO: 2498 - RNA, 19 nt, Artificial Sequence
  Description of Artificial Sequence: Synthetic oligonucleotide
gauucgacuucauuuggaa

SEQ ID NO: 2499 - RNA, 19 nt, Artificial Sequence
  Description of Artificial Sequence: Synthetic oligonucleotide
uccaaaugaagucgaaucu

SEQ ID NO: 2500 - RNA, 19 nt, Artificial Sequence
  Description of Artificial Sequence: Synthetic oligonucleotide
agauucgacuucauuugga

SEQ ID NO: 2501 - RNA, 19 nt, Artificial Sequence
  Description of Artificial Sequence: Synthetic oligonucleotide
ccaaaugaagucgaaucug

SEQ ID NO: 2502 - RNA, 19 nt, Artificial Sequence
  Description of Artificial Sequence: Synthetic oligonucleotide
cagauucgacuucauuugg

SEQ ID NO: 2503 - RNA, 19 nt, Artificial Sequence
  Description of Artificial Sequence: Synthetic oligonucleotide
aaaugaagucgaaucugcc

SEQ ID NO: 2504 - RNA, 19 nt, Artificial Sequence
  Description of Artificial Sequence: Synthetic oligonucleotide
ggcagauucgacuucauuu

SEQ ID NO: 2505 - RNA, 19 nt, Artificial Sequence
  Description of Artificial Sequence: Synthetic oligonucleotide
aaugaagucgaaucugccc

SEQ ID NO: 2506 - RNA, 19 nt, Artificial Sequence
  Description of Artificial Sequence: Synthetic oligonucleotide
gggcagauucgacuucauu

SEQ ID NO: 2507 - RNA, 19 nt, Artificial Sequence
  Description of Artificial Sequence: Synthetic oligonucleotide
augaagucgaaucugcccu

SEQ ID NO: 2508 - RNA, 19 nt, Artificial Sequence
  Description of Artificial Sequence: Synthetic oligonucleotide
agggcagauucgacuucau

SEQ ID NO: 2509 - RNA, 19 nt, Artificial Sequence
  Description of Artificial Sequence: Synthetic oligonucleotide
ugaagucgaaucugcccuc

SEQ ID NO: 2510 - RNA, 19 nt, Artificial Sequence
  Description of Artificial Sequence: Synthetic oligonucleotide
gagggcagauucgacuuca

SEQ ID NO: 2511 - RNA, 19 nt, Artificial Sequence
  Description of Artificial Sequence: Synthetic oligonucleotide
gaagucgaaucugcccuca

SEQ ID NO: 2512 - RNA, 19 nt, Artificial Sequence
  Description of Artificial Sequence: Synthetic oligonucleotide
ugagggcagauucgacuuc

SEQ ID NO: 2513 - RNA, 19 nt, Artificial Sequence
  Description of Artificial Sequence: Synthetic oligonucleotide
aagucgaaucugcccucac

SEQ ID NO: 2514 - RNA, 19 nt, Artificial Sequence
  Description of Artificial Sequence: Synthetic oligonucleotide
gugagggcagauucgacuu

SEQ ID NO: 2515 - RNA, 19 nt, Artificial Sequence
  Description of Artificial Sequence: Synthetic oligonucleotide
agucgaaucugcccucaca

SEQ ID NO: 2516 - RNA, 19 nt, Artificial Sequence
  Description of Artificial Sequence: Synthetic oligonucleotide
ugugagggcagauucgacu

SEQ ID NO: 2517 - RNA, 19 nt, Artificial Sequence
  Description of Artificial Sequence: Synthetic oligonucleotide
gucgaaucugcccucacag

SEQ ID NO: 2518 - RNA, 19 nt, Artificial Sequence
  Description of Artificial Sequence: Synthetic oligonucleotide
cugugagggcagauucgac

SEQ ID NO: 2519 - RNA, 19 nt, Artificial Sequence
  Description of Artificial Sequence: Synthetic oligonucleotide
uuguauuguguauuuucgg

SEQ ID NO: 2520 - RNA, 19 nt, Artificial Sequence
  Description of Artificial Sequence: Synthetic oligonucleotide
ccgaaaauacacaauacaa

SEQ ID NO: 2521 - RNA, 19 nt, Artificial Sequence
  Description of Artificial Sequence: Synthetic oligonucleotide
uguauuguguauuuucggu

SEQ ID NO: 2522 - RNA, 19 nt, Artificial Sequence
  Description of Artificial Sequence: Synthetic oligonucleotide
accgaaaauacacaauaca

SEQ ID NO: 2523 - RNA, 19 nt, Artificial Sequence
  Description of Artificial Sequence: Synthetic oligonucleotide
guauuguguauuuucgguu

SEQ ID NO: 2524 - RNA, 19 nt, Artificial Sequence
  Description of Artificial Sequence: Synthetic oligonucleotide
aaccgaaaauacacaauac

SEQ ID NO: 2525 - RNA, 19 nt, Artificial Sequence
  Description of Artificial Sequence: Synthetic oligonucleotide
aaauauuuagaugcagcac

SEQ ID NO: 2526 - RNA, 19 nt, Artificial Sequence
  Description of Artificial Sequence: Synthetic oligonucleotide
gugcugcaucuaaauauuu

SEQ ID NO: 2527 - RNA, 19 nt, Artificial Sequence
  Description of Artificial Sequence: Synthetic oligonucleotide
auuuagaugcagcaccaua

SEQ ID NO: 2528 - RNA, 19 nt, Artificial Sequence
  Description of Artificial Sequence: Synthetic oligonucleotide
uauggugcugcaucuaaau

SEQ ID NO: 2529 - RNA, 19 nt, Artificial Sequence
  Description of Artificial Sequence: Synthetic oligonucleotide
uuuagaugcagcaccauau

SEQ ID NO: 2530 - RNA, 19 nt, Artificial Sequence
  Description of Artificial Sequence: Synthetic oligonucleotide
auauggugcugcaucuaaa

SEQ ID NO: 2531 - RNA, 19 nt, Artificial Sequence
  Description of Artificial Sequence: Synthetic oligonucleotide
uuagaugcagcaccauauu

SEQ ID NO: 2532 - RNA, 19 nt, Artificial Sequence
  Description of Artificial Sequence: Synthetic oligonucleotide
aauauggugcugcaucuaa

SEQ ID NO: 2533 - RNA, 19 nt, Artificial Sequence
  Description of Artificial Sequence: Synthetic oligonucleotide
uagaugcagcaccauauuu

SEQ ID NO: 2534 - RNA, 19 nt, Artificial Sequence
  Description of Artificial Sequence: Synthetic oligonucleotide
aaauauggugcugcaucua

SEQ ID NO: 2535 - RNA, 19 nt, Artificial Sequence
  Description of Artificial Sequence: Synthetic oligonucleotide
agaugcagcaccauauuuu

SEQ ID NO: 2536 - RNA, 19 nt, Artificial Sequence
  Description of Artificial Sequence: Synthetic oligonucleotide
aaaauauggugcugcaucu

SEQ ID NO: 2537 - RNA, 19 nt, Artificial Sequence
  Description of Artificial Sequence: Synthetic oligonucleotide
gaugcagcaccauauuuua

SEQ ID NO: 2538 - RNA, 19 nt, Artificial Sequence
  Description of Artificial Sequence: Synthetic oligonucleotide
uaaaauauggugcugcauc

SEQ ID NO: 2539 - RNA, 19 nt, Artificial Sequence
  Description of Artificial Sequence: Synthetic oligonucleotide
augcagcaccauauuuuau

SEQ ID NO: 2540 - RNA, 19 nt, Artificial Sequence
  Description of Artificial Sequence: Synthetic oligonucleotide
auaaaauauggugcugcau

SEQ ID NO: 2541 - RNA, 19 nt, Artificial Sequence
  Description of Artificial Sequence: Synthetic oligonucleotide
agcaccauauuuuauaacc

SEQ ID NO: 2542 - RNA, 19 nt, Artificial Sequence
  Description of Artificial Sequence: Synthetic oligonucleotide
gguuauaaaauauggugcu

SEQ ID NO: 2543 - RNA, 19 nt, Artificial Sequence
  Description of Artificial Sequence: Synthetic oligonucleotide
gcaccauauuuuauaaccc

SEQ ID NO: 2544 - RNA, 19 nt, Artificial Sequence
  Description of Artificial Sequence: Synthetic oligonucleotide
ggguuauaaaauauggugc

SEQ ID NO: 2545 - RNA, 19 nt, Artificial Sequence
  Description of Artificial Sequence: Synthetic oligonucleotide
accauauuuuauaacccag

SEQ ID NO: 2546 - RNA, 19 nt, Artificial Sequence
  Description of Artificial Sequence: Synthetic oligonucleotide
cuggguuauaaaauauggu

SEQ ID NO: 2547 - RNA, 19 nt, Artificial Sequence
  Description of Artificial Sequence: Synthetic oligonucleotide
ccauauuuuauaacccagc

SEQ ID NO: 2548 - RNA, 19 nt, Artificial Sequence
  Description of Artificial Sequence: Synthetic oligonucleotide
gcuggguuauaaaauaugg

SEQ ID NO: 2549 - RNA, 19 nt, Artificial Sequence
  Description of Artificial Sequence: Synthetic oligonucleotide
cauauuuuauaacccagcu

SEQ ID NO: 2550 - RNA, 19 nt, Artificial Sequence
  Description of Artificial Sequence: Synthetic oligonucleotide
agcuggguuauaaaauaug

SEQ ID NO: 2551 - RNA, 19 nt, Artificial Sequence
  Description of Artificial Sequence: Synthetic oligonucleotide
uuauaacccagcuuuagca

SEQ ID NO: 2552 - RNA, 19 nt, Artificial Sequence
  Description of Artificial Sequence: Synthetic oligonucleotide
ugcuaaagcuggguuauaa

SEQ ID NO: 2553 - RNA, 19 nt, Artificial Sequence
  Description of Artificial Sequence: Synthetic oligonucleotide
acccagcuuuagcauuucu

SEQ ID NO: 2554 - RNA, 19 nt, Artificial Sequence
  Description of Artificial Sequence: Synthetic oligonucleotide
agaaaugcuaaagcugggu

SEQ ID NO: 2555 - RNA, 19 nt, Artificial Sequence
  Description of Artificial Sequence: Synthetic oligonucleotide
ccagcuuuagcauuucuuc

SEQ ID NO: 2556 - RNA, 19 nt, Artificial Sequence
  Description of Artificial Sequence: Synthetic oligonucleotide
gaagaaaugcuaaagcugg

SEQ ID NO: 2557 - RNA, 19 nt, Artificial Sequence
  Description of Artificial Sequence: Synthetic oligonucleotide
ggcgcuucuugcucucuga

SEQ ID NO: 2558 - RNA, 19 nt, Artificial Sequence
  Description of Artificial Sequence: Synthetic oligonucleotide
ucagagagcaagaagcgcc

SEQ ID NO: 2559 - RNA, 19 nt, Artificial Sequence
  Description of Artificial Sequence: Synthetic oligonucleotide
gcgcuucuugcucucugaa

SEQ ID NO: 2560 - RNA, 19 nt, Artificial Sequence
  Description of Artificial Sequence: Synthetic oligonucleotide
uucagagagcaagaagcgc

SEQ ID NO: 2561 - RNA, 19 nt, Artificial Sequence
  Description of Artificial Sequence: Synthetic oligonucleotide
aaaugcccugcuaaaugcu

SEQ ID NO: 2562 - RNA, 19 nt, Artificial Sequence
  Description of Artificial Sequence: Synthetic oligonucleotide
agcauuuagcagggcauuu

SEQ ID NO: 2563 - RNA, 19 nt, Artificial Sequence
  Description of Artificial Sequence: Synthetic oligonucleotide
aaugcccugcuaaaugcuu

SEQ ID NO: 2564 - RNA, 19 nt, Artificial Sequence
  Description of Artificial Sequence: Synthetic oligonucleotide
aagcauuuagcagggcauu

SEQ ID NO: 2565 - RNA, 19 nt, Artificial Sequence
  Description of Artificial Sequence: Synthetic oligonucleotide
augcccugcuaaaugcuuc

SEQ ID NO: 2566 - RNA, 19 nt, Artificial Sequence
  Description of Artificial Sequence: Synthetic oligonucleotide
gaagcauuuagcagggcau

SEQ ID NO: 2567 - RNA, 19 nt, Artificial Sequence
  Description of Artificial Sequence: Synthetic oligonucleotide
ugcccugcuaaaugcuucu

SEQ ID NO: 2568 - RNA, 19 nt, Artificial Sequence
  Description of Artificial Sequence: Synthetic oligonucleotide
agaagcauuuagcagggca

SEQ ID NO: 2569 - RNA, 19 nt, Artificial Sequence
  Description of Artificial Sequence: Synthetic oligonucleotide
uuugaauaagguaguuugg

SEQ ID NO: 2570 - RNA, 19 nt, Artificial Sequence
  Description of Artificial Sequence: Synthetic oligonucleotide
ccaaacuaccuuauucaaa

SEQ ID NO: 2571 - RNA, 19 nt, Artificial Sequence
  Description of Artificial Sequence: Synthetic oligonucleotide
uugaauaagguaguuugga

SEQ ID NO: 2572 - RNA, 19 nt, Artificial Sequence
  Description of Artificial Sequence: Synthetic oligonucleotide
uccaaacuaccuuauucaa

SEQ ID NO: 2573 - RNA, 19 nt, Artificial Sequence
  Description of Artificial Sequence: Synthetic oligonucleotide
ugaauaagguaguuuggaa

SEQ ID NO: 2574 - RNA, 19 nt, Artificial Sequence
  Description of Artificial Sequence: Synthetic oligonucleotide
uuccaaacuaccuuauuca

SEQ ID NO: 2575 - RNA, 19 nt, Artificial Sequence
  Description of Artificial Sequence: Synthetic oligonucleotide
gaauaagguaguuuggaau

SEQ ID NO: 2576 - RNA, 19 nt, Artificial Sequence
  Description of Artificial Sequence: Synthetic oligonucleotide
auuccaaacuaccuuauuc

SEQ ID NO: 2577 - RNA, 19 nt, Artificial Sequence
  Description of Artificial Sequence: Synthetic oligonucleotide
agguaguuuggaauaaaga

SEQ ID NO: 2578 - RNA, 19 nt, Artificial Sequence
  Description of Artificial Sequence: Synthetic oligonucleotide
ucuuuauuccaaacuaccu

SEQ ID NO: 2579 - RNA, 19 nt, Artificial Sequence
  Description of Artificial Sequence: Synthetic oligonucleotide
gaucacucuacauacagau

SEQ ID NO: 2580 - RNA, 19 nt, Artificial Sequence
  Description of Artificial Sequence: Synthetic oligonucleotide
aucuguauguagagugauc

SEQ ID NO: 2581 - RNA, 19 nt, Artificial Sequence
  Description of Artificial Sequence: Synthetic oligonucleotide
aucacucuacauacagaua

SEQ ID NO: 2582 - RNA, 19 nt, Artificial Sequence
  Description of Artificial Sequence: Synthetic oligonucleotide
uaucuguauguagagugau

SEQ ID NO: 2583 - RNA, 19 nt, Artificial Sequence
  Description of Artificial Sequence: Synthetic oligonucleotide
ucacucuacauacagauag

SEQ ID NO: 2584 - RNA, 19 nt, Artificial Sequence
  Description of Artificial Sequence: Synthetic oligonucleotide
cuaucuguauguagaguga

SEQ ID NO: 2585 - RNA, 19 nt, Artificial Sequence
  Description of Artificial Sequence: Synthetic oligonucleotide
cacucuacauacagauagu

SEQ ID NO: 2586 - RNA, 19 nt, Artificial Sequence
  Description of Artificial Sequence: Synthetic oligonucleotide
acuaucuguauguagagug

SEQ ID NO: 2587 - RNA, 19 nt, Artificial Sequence
  Description of Artificial Sequence: Synthetic oligonucleotide
acucuacauacagauagua

SEQ ID NO: 2588 - RNA, 19 nt, Artificial Sequence
  Description of Artificial Sequence: Synthetic oligonucleotide
uacuaucuguauguagagu

SEQ ID NO: 2589 - RNA, 19 nt, Artificial Sequence
  Description of Artificial Sequence: Synthetic oligonucleotide
cucuacauacagauaguaa

SEQ ID NO: 2590 - RNA, 19 nt, Artificial Sequence
  Description of Artificial Sequence: Synthetic oligonucleotide
uuacuaucuguauguagag

SEQ ID NO: 2591 - RNA, 19 nt, Artificial Sequence
  Description of Artificial Sequence: Synthetic oligonucleotide
uguaaaugacugauguuug

SEQ ID NO: 2592 - RNA, 19 nt, Artificial Sequence
  Description of Artificial Sequence: Synthetic oligonucleotide
caaacaucagucauuuaca

SEQ ID NO: 2593 - RNA, 19 nt, Artificial Sequence
  Description of Artificial Sequence: Synthetic oligonucleotide
guaaaugacugauguuugc

SEQ ID NO: 2594 - RNA, 19 nt, Artificial Sequence
  Description of Artificial Sequence: Synthetic oligonucleotide
gcaaacaucagucauuuac

SEQ ID NO: 2595 - RNA, 19 nt, Artificial Sequence
  Description of Artificial Sequence: Synthetic oligonucleotide
uaaaugacugauguuugca

SEQ ID NO: 2596 - RNA, 19 nt, Artificial Sequence
  Description of Artificial Sequence: Synthetic oligonucleotide
ugcaaacaucagucauuua

SEQ ID NO: 2597 - RNA, 19 nt, Artificial Sequence
  Description of Artificial Sequence: Synthetic oligonucleotide
aaaugacugauguuugcau

SEQ ID NO: 2598 - RNA, 19 nt, Artificial Sequence
  Description of Artificial Sequence: Synthetic oligonucleotide
augcaaacaucagucauuu

SEQ ID NO: 2599 - RNA, 19 nt, Artificial Sequence
  Description of Artificial Sequence: Synthetic oligonucleotide
gauguuugcauuauuaagg

SEQ ID NO: 2600 - RNA, 19 nt, Artificial Sequence
  Description of Artificial Sequence: Synthetic oligonucleotide
ccuuaauaaugcaaacauc

SEQ ID NO: 2601 - RNA, 19 nt, Artificial Sequence
  Description of Artificial Sequence: Synthetic oligonucleotide
acuugggauguugggucaa

SEQ ID NO: 2602 - RNA, 19 nt, Artificial Sequence
  Description of Artificial Sequence: Synthetic oligonucleotide
uugacccaacaucccaagu

SEQ ID NO: 2603 - RNA, 19 nt, Artificial Sequence
  Description of Artificial Sequence: Synthetic oligonucleotide
uugggauguugggucaaga

SEQ ID NO: 2604 - RNA, 19 nt, Artificial Sequence
  Description of Artificial Sequence: Synthetic oligonucleotide
ucuugacccaacaucccaa

SEQ ID NO: 2605 - RNA, 19 nt, Artificial Sequence
  Description of Artificial Sequence: Synthetic oligonucleotide
ugggauguugggucaagag

SEQ ID NO: 2606 - RNA, 19 nt, Artificial Sequence
  Description of Artificial Sequence: Synthetic oligonucleotide
cucuugacccaacauccca

SEQ ID NO: 2607 - RNA, 19 nt, Artificial Sequence
  Description of Artificial Sequence: Synthetic oligonucleotide
gggauguugggucaagagg

SEQ ID NO: 2608 - RNA, 19 nt, Artificial Sequence
  Description of Artificial Sequence: Synthetic oligonucleotide
ccucuugacccaacauccc

SEQ ID NO: 2609 - RNA, 19 nt, Artificial Sequence
  Description of Artificial Sequence: Synthetic oligonucleotide
aaaguguuagucaauccac

SEQ ID NO: 2610 - RNA, 19 nt, Artificial Sequence
  Description of Artificial Sequence: Synthetic oligonucleotide
guggauugacuaacacuuu

SEQ ID NO: 2611 - RNA, 19 nt, Artificial Sequence
  Description of Artificial Sequence: Synthetic oligonucleotide
gaaggucaauuauaauucc

SEQ ID NO: 2612 - RNA, 19 nt, Artificial Sequence
  Description of Artificial Sequence: Synthetic oligonucleotide
ggaauuauaauugaccuuc

SEQ ID NO: 2613 - RNA, 19 nt, Artificial Sequence
  Description of Artificial Sequence: Synthetic oligonucleotide
ccauauaccuuucuuugau

SEQ ID NO: 2614 - RNA, 19 nt, Artificial Sequence
  Description of Artificial Sequence: Synthetic oligonucleotide
aucaaagaaagguauaugg

SEQ ID NO: 2615 - RNA, 19 nt, Artificial Sequence
  Description of Artificial Sequence: Synthetic oligonucleotide
cauauaccuuucuuugaug

SEQ ID NO: 2616 - RNA, 19 nt, Artificial Sequence
  Description of Artificial Sequence: Synthetic oligonucleotide
caucaaagaaagguauaug

SEQ ID NO: 2617 - RNA, 19 nt, Artificial Sequence
  Description of Artificial Sequence: Synthetic oligonucleotide
auauaccuuucuuugaugc

SEQ ID NO: 2618 - RNA, 19 nt, Artificial Sequence
  Description of Artificial Sequence: Synthetic oligonucleotide
gcaucaaagaaagguauau

SEQ ID NO: 2619 - RNA, 19 nt, Artificial Sequence
  Description of Artificial Sequence: Synthetic oligonucleotide
uauaccuuucuuugaugcc

SEQ ID NO: 2620 - RNA, 19 nt, Artificial Sequence
  Description of Artificial Sequence: Synthetic oligonucleotide
ggcaucaaagaaagguaua

SEQ ID NO: 2621 - RNA, 19 nt, Artificial Sequence
  Description of Artificial Sequence: Synthetic oligonucleotide
accuuucuuugaugccaca

SEQ ID NO: 2622 - RNA, 19 nt, Artificial Sequence
  Description of Artificial Sequence: Synthetic oligonucleotide
uguggcaucaaagaaaggu

SEQ ID NO: 2623 - RNA, 19 nt, Artificial Sequence
  Description of Artificial Sequence: Synthetic oligonucleotide
agaauacaguuuggguggc

SEQ ID NO: 2624 - RNA, 19 nt, Artificial Sequence
  Description of Artificial Sequence: Synthetic oligonucleotide
gccacccaaacuguauucu

SEQ ID NO: 2625 - RNA, 19 nt, Artificial Sequence
  Description of Artificial Sequence: Synthetic oligonucleotide
gaauacaguuuggguggcc

SEQ ID NO: 2626 - RNA, 19 nt, Artificial Sequence
  Description of Artificial Sequence: Synthetic oligonucleotide
ggccacccaaacuguauuc

SEQ ID NO: 2627 - RNA, 19 nt, Artificial Sequence
  Description of Artificial Sequence: Synthetic oligonucleotide
aauacaguuuggguggcca

SEQ ID NO: 2628 - RNA, 19 nt, Artificial Sequence
  Description of Artificial Sequence: Synthetic oligonucleotide
uggccacccaaacuguauu

SEQ ID NO: 2629 - RNA, 19 nt, Artificial Sequence
  Description of Artificial Sequence: Synthetic oligonucleotide
auacaguuuggguggccau

SEQ ID NO: 2630 - RNA, 19 nt, Artificial Sequence
  Description of Artificial Sequence: Synthetic oligonucleotide
auggccacccaaacuguau

SEQ ID NO: 2631 - RNA, 19 nt, Artificial Sequence
  Description of Artificial Sequence: Synthetic oligonucleotide
uacaguuuggguggccaug

SEQ ID NO: 2632 - RNA, 19 nt, Artificial Sequence
  Description of Artificial Sequence: Synthetic oligonucleotide
cauggccacccaaacugua

SEQ ID NO: 2633 - RNA, 19 nt, Artificial Sequence
  Description of Artificial Sequence: Synthetic oligonucleotide
acaguuuggguggccaugg

SEQ ID NO: 2634 - RNA, 19 nt, Artificial Sequence
  Description of Artificial Sequence: Synthetic oligonucleotide
ccauggccacccaaacugu

SEQ ID NO: 2635 - RNA, 19 nt, Artificial Sequence
  Description of Artificial Sequence: Synthetic oligonucleotide
caguuuggguggccaugga

SEQ ID NO: 2636 - RNA, 19 nt, Artificial Sequence
  Description of Artificial Sequence: Synthetic oligonucleotide
uccauggccacccaaacug

SEQ ID NO: 2637 - RNA, 19 nt, Artificial Sequence
  Description of Artificial Sequence: Synthetic oligonucleotide
aguuuggguggccauggau

SEQ ID NO: 2638 - RNA, 19 nt, Artificial Sequence
  Description of Artificial Sequence: Synthetic oligonucleotide
auccauggccacccaaacu

SEQ ID NO: 2639 - RNA, 19 nt, Artificial Sequence
  Description of Artificial Sequence: Synthetic oligonucleotide
guuuggguggccauggaug

SEQ ID NO: 2640 - RNA, 19 nt, Artificial Sequence
  Description of Artificial Sequence: Synthetic oligonucleotide
cauccauggccacccaaac

SEQ ID NO: 2641 - RNA, 19 nt, Artificial Sequence
  Description of Artificial Sequence: Synthetic oligonucleotide
uuuggguggccauggaugu

SEQ ID NO: 2642 - RNA, 19 nt, Artificial Sequence
  Description of Artificial Sequence: Synthetic oligonucleotide
acauccauggccacccaaa

SEQ ID NO: 2643 - RNA, 19 nt, Artificial Sequence
  Description of Artificial Sequence: Synthetic oligonucleotide
ucagaucauuucauggaau

SEQ ID NO: 2644 - RNA, 19 nt, Artificial Sequence
  Description of Artificial Sequence: Synthetic oligonucleotide
auuccaugaaaugaucuga

SEQ ID NO: 2645 - RNA, 19 nt, Artificial Sequence
  Description of Artificial Sequence: Synthetic oligonucleotide
cagaucauuucauggaauc

SEQ ID NO: 2646 - RNA, 19 nt, Artificial Sequence
  Description of Artificial Sequence: Synthetic oligonucleotide
gauuccaugaaaugaucug

SEQ ID NO: 2647 - RNA, 19 nt, Artificial Sequence
  Description of Artificial Sequence: Synthetic oligonucleotide
gaucauuucauggaaucuu

SEQ ID NO: 2648 - RNA, 19 nt, Artificial Sequence
  Description of Artificial Sequence: Synthetic oligonucleotide
aagauuccaugaaaugauc

SEQ ID NO: 2649 - RNA, 19 nt, Artificial Sequence
  Description of Artificial Sequence: Synthetic oligonucleotide
aaguaucuuugacucuaac

SEQ ID NO: 2650 - RNA, 19 nt, Artificial Sequence
  Description of Artificial Sequence: Synthetic oligonucleotide
guuagagucaaagauacuu

SEQ ID NO: 2651 - RNA, 19 nt, Artificial Sequence
  Description of Artificial Sequence: Synthetic oligonucleotide
aguaucuuugacucuaacu

SEQ ID NO: 2652 - RNA, 19 nt, Artificial Sequence
  Description of Artificial Sequence: Synthetic oligonucleotide
aguuagagucaaagauacu

SEQ ID NO: 2653 - RNA, 19 nt, Artificial Sequence
  Description of Artificial Sequence: Synthetic oligonucleotide
guaucuuugacucuaacuu

SEQ ID NO: 2654 - RNA, 19 nt, Artificial Sequence
  Description of Artificial Sequence: Synthetic oligonucleotide
aaguuagagucaaagauac

SEQ ID NO: 2655 - RNA, 19 nt, Artificial Sequence
  Description of Artificial Sequence: Synthetic oligonucleotide
aucuuugacucuaacuuug

SEQ ID NO: 2656 - RNA, 19 nt, Artificial Sequence
  Description of Artificial Sequence: Synthetic oligonucleotide
caaaguuagagucaaagau

SEQ ID NO: 2657 - RNA, 19 nt, Artificial Sequence
  Description of Artificial Sequence: Synthetic oligonucleotide
ucuuugacucuaacuuuga

SEQ ID NO: 2658 - RNA, 19 nt, Artificial Sequence
  Description of Artificial Sequence: Synthetic oligonucleotide
ucaaaguuagagucaaaga

SEQ ID NO: 2659 - RNA, 19 nt, Artificial Sequence
  Description of Artificial Sequence: Synthetic oligonucleotide
cuuugacucuaacuuugac

SEQ ID NO: 2660 - RNA, 19 nt, Artificial Sequence
  Description of Artificial Sequence: Synthetic oligonucleotide
gucaaaguuagagucaaag

SEQ ID NO: 2661 - RNA, 19 nt, Artificial Sequence
  Description of Artificial Sequence: Synthetic oligonucleotide
uuugacucuaacuuugacu

SEQ ID NO: 2662 - RNA, 19 nt, Artificial Sequence
  Description of Artificial Sequence: Synthetic oligonucleotide
agucaaaguuagagucaaa

SEQ ID NO: 2663 - RNA, 19 nt, Artificial Sequence
  Description of Artificial Sequence: Synthetic oligonucleotide
uugacucuaacuuugacuu

SEQ ID NO: 2664 - RNA, 19 nt, Artificial Sequence
  Description of Artificial Sequence: Synthetic oligonucleotide
aagucaaaguuagagucaa

SEQ ID NO: 2665 - RNA, 19 nt, Artificial Sequence
  Description of Artificial Sequence: Synthetic oligonucleotide
cucuaacuuugacuuggug

SEQ ID NO: 2666 - RNA, 19 nt, Artificial Sequence
  Description of Artificial Sequence: Synthetic oligonucleotide
caccaagucaaaguuagag

SEQ ID NO: 2667 - RNA, 19 nt, Artificial Sequence
  Description of Artificial Sequence: Synthetic oligonucleotide
ucuaacuuugacuuggugg

SEQ ID NO: 2668 - RNA, 19 nt, Artificial Sequence
  Description of Artificial Sequence: Synthetic oligonucleotide
ccaccaagucaaaguuaga

SEQ ID NO: 2669 - RNA, 19 nt, Artificial Sequence
  Description of Artificial Sequence: Synthetic oligonucleotide
cuaacuuugacuugguggu

SEQ ID NO: 2670 - RNA, 19 nt, Artificial Sequence
  Description of Artificial Sequence: Synthetic oligonucleotide
accaccaagucaaaguuag

SEQ ID NO: 2671 - RNA, 19 nt, Artificial Sequence
  Description of Artificial Sequence: Synthetic oligonucleotide
uaacuuugacuugguggug

SEQ ID NO: 2672 - RNA, 19 nt, Artificial Sequence
  Description of Artificial Sequence: Synthetic oligonucleotide
caccaccaagucaaaguua

SEQ ID NO: 2673 - RNA, 19 nt, Artificial Sequence
  Description of Artificial Sequence: Synthetic oligonucleotide
acuuugacuugguggugga

SEQ ID NO: 2674 - RNA, 19 nt, Artificial Sequence
  Description of Artificial Sequence: Synthetic oligonucleotide
uccaccaccaagucaaagu

SEQ ID NO: 2675 - RNA, 19 nt, Artificial Sequence
  Description of Artificial Sequence: Synthetic oligonucleotide
cuuugacuuggugguggac

SEQ ID NO: 2676 - RNA, 19 nt, Artificial Sequence
  Description of Artificial Sequence: Synthetic oligonucleotide
guccaccaccaagucaaag

SEQ ID NO: 2677 - RNA, 19 nt, Artificial Sequence
  Description of Artificial Sequence: Synthetic oligonucleotide
uuugacuuggugguggacc

SEQ ID NO: 2678 - RNA, 19 nt, Artificial Sequence
  Description of Artificial Sequence: Synthetic oligonucleotide
gguccaccaccaagucaaa

SEQ ID NO: 2679 - RNA, 19 nt, Artificial Sequence
  Description of Artificial Sequence: Synthetic oligonucleotide
uugacuuggugguggaccu

SEQ ID NO: 2680 - RNA, 19 nt, Artificial Sequence
  Description of Artificial Sequence: Synthetic oligonucleotide
agguccaccaccaagucaa

SEQ ID NO: 2681 - RNA, 19 nt, Artificial Sequence
  Description of Artificial Sequence: Synthetic oligonucleotide
ugacuuggugguggaccuu

SEQ ID NO: 2682 - RNA, 19 nt, Artificial Sequence
  Description of Artificial Sequence: Synthetic oligonucleotide
aagguccaccaccaaguca

SEQ ID NO: 2683 - RNA, 19 nt, Artificial Sequence
  Description of Artificial Sequence: Synthetic oligonucleotide
uuggugguggaccuuccuu

SEQ ID NO: 2684 - RNA, 19 nt, Artificial Sequence
  Description of Artificial Sequence: Synthetic oligonucleotide
aaggaagguccaccaccaa

SEQ ID NO: 2685 - RNA, 19 nt, Artificial Sequence
  Description of Artificial Sequence: Synthetic oligonucleotide
uggugguggaccuuccuug

SEQ ID NO: 2686 - RNA, 19 nt, Artificial Sequence
  Description of Artificial Sequence: Synthetic oligonucleotide
caaggaagguccaccacca

SEQ ID NO: 2687 - RNA, 19 nt, Artificial Sequence
  Description of Artificial Sequence: Synthetic oligonucleotide
ggugguggaccuuccuugg

SEQ ID NO: 2688 - RNA, 19 nt, Artificial Sequence
  Description of Artificial Sequence: Synthetic oligonucleotide
ccaaggaagguccaccacc

SEQ ID NO: 2689 - RNA, 19 nt, Artificial Sequence
  Description of Artificial Sequence: Synthetic oligonucleotide
gugguggaccuuccuuggu

SEQ ID NO: 2690 - RNA, 19 nt, Artificial Sequence
  Description of Artificial Sequence: Synthetic oligonucleotide
accaaggaagguccaccac

SEQ ID NO: 2691 - RNA, 19 nt, Artificial Sequence
  Description of Artificial Sequence: Synthetic oligonucleotide
ugguggaccuuccuugguu

SEQ ID NO: 2692 - RNA, 19 nt, Artificial Sequence
  Description of Artificial Sequence: Synthetic oligonucleotide
aaccaaggaagguccacca

SEQ ID NO: 2693 - RNA, 19 nt, Artificial Sequence
  Description of Artificial Sequence: Synthetic oligonucleotide
gguggaccuuccuugguuu

SEQ ID NO: 2694 - RNA, 19 nt, Artificial Sequence
  Description of Artificial Sequence: Synthetic oligonucleotide
aaaccaaggaagguccacc

SEQ ID NO: 2695 - RNA, 19 nt, Artificial Sequence
  Description of Artificial Sequence: Synthetic oligonucleotide
guggaccuuccuugguuuu

SEQ ID NO: 2696 - RNA, 19 nt, Artificial Sequence
  Description of Artificial Sequence: Synthetic oligonucleotide
aaaaccaaggaagguccac

SEQ ID NO: 2697 - RNA, 19 nt, Artificial Sequence
  Description of Artificial Sequence: Synthetic oligonucleotide
cauguauuuuagcauaagg

SEQ ID NO: 2698 - RNA, 19 nt, Artificial Sequence
  Description of Artificial Sequence: Synthetic oligonucleotide
ccuuaugcuaaaauacaug

SEQ ID NO: 2699 - RNA, 19 nt, Artificial Sequence
  Description of Artificial Sequence: Synthetic oligonucleotide
aaauguguaugaguuucag

SEQ ID NO: 2700 - RNA, 19 nt, Artificial Sequence
  Description of Artificial Sequence: Synthetic oligonucleotide
cugaaacucauacacauuu

SEQ ID NO: 2701 - RNA, 19 nt, Artificial Sequence
  Description of Artificial Sequence: Synthetic oligonucleotide
aauguguaugaguuucagu

SEQ ID NO: 2702 - RNA, 19 nt, Artificial Sequence
  Description of Artificial Sequence: Synthetic oligonucleotide
acugaaacucauacacauu

SEQ ID NO: 2703 - RNA, 19 nt, Artificial Sequence
  Description of Artificial Sequence: Synthetic oligonucleotide
auguguaugaguuucagua

SEQ ID NO: 2704 - RNA, 19 nt, Artificial Sequence
  Description of Artificial Sequence: Synthetic oligonucleotide
uacugaaacucauacacau

SEQ ID NO: 2705 - RNA, 19 nt, Artificial Sequence
  Description of Artificial Sequence: Synthetic oligonucleotide
guguaugaguuucaguaga

SEQ ID NO: 2706 - RNA, 19 nt, Artificial Sequence
  Description of Artificial Sequence: Synthetic oligonucleotide
ucuacugaaacucauacac

SEQ ID NO: 2707 - RNA, 19 nt, Artificial Sequence
  Description of Artificial Sequence: Synthetic oligonucleotide
uguaugaguuucaguagaa

SEQ ID NO: 2708 - RNA, 19 nt, Artificial Sequence
  Description of Artificial Sequence: Synthetic oligonucleotide
uucuacugaaacucauaca

SEQ ID NO: 2709 - RNA, 19 nt, Artificial Sequence
  Description of Artificial Sequence: Synthetic oligonucleotide
uuccauaaauaugcagagu

SEQ ID NO: 2710 - RNA, 19 nt, Artificial Sequence
  Description of Artificial Sequence: Synthetic oligonucleotide
acucugcauauuuauggaa

SEQ ID NO: 2711 - RNA, 19 nt, Artificial Sequence
  Description of Artificial Sequence: Synthetic oligonucleotide
ccauaaauaugcagaguuc

SEQ ID NO: 2712 - RNA, 19 nt, Artificial Sequence
  Description of Artificial Sequence: Synthetic oligonucleotide
gaacucugcauauuuaugg

SEQ ID NO: 2713 - RNA, 19 nt, Artificial Sequence
  Description of Artificial Sequence: Synthetic oligonucleotide
ugaaugcauuugcaauuuc

SEQ ID NO: 2714 - RNA, 19 nt, Artificial Sequence
  Description of Artificial Sequence: Synthetic oligonucleotide
gaaauugcaaaugcauuca

SEQ ID NO: 2715 - RNA, 19 nt, Artificial Sequence
  Description of Artificial Sequence: Synthetic oligonucleotide
gaaugcauuugcaauuucu

SEQ ID NO: 2716 - RNA, 19 nt, Artificial Sequence
  Description of Artificial Sequence: Synthetic oligonucleotide
agaaauugcaaaugcauuc

SEQ ID NO: 2717 - RNA, 19 nt, Artificial Sequence
  Description of Artificial Sequence: Synthetic oligonucleotide
augcauuugcaauuucuag

SEQ ID NO: 2718 - RNA, 19 nt, Artificial Sequence
  Description of Artificial Sequence: Synthetic oligonucleotide
cuagaaauugcaaaugcau

SEQ ID NO: 2719 - RNA, 19 nt, Artificial Sequence
  Description of Artificial Sequence: Synthetic oligonucleotide
ugcauuugcaauuucuagg

SEQ ID NO: 2720 - RNA, 19 nt, Artificial Sequence
  Description of Artificial Sequence: Synthetic oligonucleotide
ccuagaaauugcaaaugca

SEQ ID NO: 2721 - RNA, 19 nt, Artificial Sequence
  Description of Artificial Sequence: Synthetic oligonucleotide
gcauuugcaauuucuagga

SEQ ID NO: 2722 - RNA, 19 nt, Artificial Sequence
  Description of Artificial Sequence: Synthetic oligonucleotide
uccuagaaauugcaaaugc

SEQ ID NO: 2723 - RNA, 19 nt, Artificial Sequence
  Description of Artificial Sequence: Synthetic oligonucleotide
cauuugcaauuucuaggau

SEQ ID NO: 2724 - RNA, 19 nt, Artificial Sequence
  Description of Artificial Sequence: Synthetic oligonucleotide
auccuagaaauugcaaaug

SEQ ID NO: 2725 - RNA, 19 nt, Artificial Sequence
  Description of Artificial Sequence: Synthetic oligonucleotide
uuugcaauuucuaggauuc

SEQ ID NO: 2726 - RNA, 19 nt, Artificial Sequence
  Description of Artificial Sequence: Synthetic oligonucleotide
gaauccuagaaauugcaaa

SEQ ID NO: 2727 - RNA, 19 nt, Artificial Sequence
  Description of Artificial Sequence: Synthetic oligonucleotide
ugcaauuucuaggauucua

SEQ ID NO: 2728 - RNA, 19 nt, Artificial Sequence
  Description of Artificial Sequence: Synthetic oligonucleotide
uagaauccuagaaauugca

SEQ ID NO: 2729 - RNA, 19 nt, Artificial Sequence
  Description of Artificial Sequence: Synthetic oligonucleotide
gcaauuucuaggauucuaa

SEQ ID NO: 2730 - RNA, 19 nt, Artificial Sequence
  Description of Artificial Sequence: Synthetic oligonucleotide
uuagaauccuagaaauugc

SEQ ID NO: 2731 - RNA, 19 nt, Artificial Sequence
  Description of Artificial Sequence: Synthetic oligonucleotide
ucuaaagaauugaguacag

SEQ ID NO: 2732 - RNA, 19 nt, Artificial Sequence
  Description of Artificial Sequence: Synthetic oligonucleotide
cuguacucaauucuuuaga

SEQ ID NO: 2733 - RNA, 19 nt, Artificial Sequence
  Description of Artificial Sequence: Synthetic oligonucleotide
cuaaagaauugaguacaga

SEQ ID NO: 2734 - RNA, 19 nt, Artificial Sequence
  Description of Artificial Sequence: Synthetic oligonucleotide
ucuguacucaauucuuuag

SEQ ID NO: 2735 - RNA, 19 nt, Artificial Sequence
  Description of Artificial Sequence: Synthetic oligonucleotide
agaauuacugugccaauac

SEQ ID NO: 2736 - RNA, 19 nt, Artificial Sequence
  Description of Artificial Sequence: Synthetic oligonucleotide
guauuggcacaguaauucu

SEQ ID NO: 2737 - RNA, 19 nt, Artificial Sequence
  Description of Artificial Sequence: Synthetic oligonucleotide
gaauuacugugccaauacu

SEQ ID NO: 2738 - RNA, 19 nt, Artificial Sequence
  Description of Artificial Sequence: Synthetic oligonucleotide
aguauuggcacaguaauuc

SEQ ID NO: 2739 - RNA, 19 nt, Artificial Sequence
  Description of Artificial Sequence: Synthetic oligonucleotide
aauuacugugccaauacug

SEQ ID NO: 2740 - RNA, 19 nt, Artificial Sequence
  Description of Artificial Sequence: Synthetic oligonucleotide
caguauuggcacaguaauu

SEQ ID NO: 2741 - RNA, 19 nt, Artificial Sequence
  Description of Artificial Sequence: Synthetic oligonucleotide
cugugccaauacuguuuug

SEQ ID NO: 2742 - RNA, 19 nt, Artificial Sequence
  Description of Artificial Sequence: Synthetic oligonucleotide
caaaacaguauuggcacag

SEQ ID NO: 2743 - RNA, 19 nt, Artificial Sequence
  Description of Artificial Sequence: Synthetic oligonucleotide
ugugccaauacuguuuuga

SEQ ID NO: 2744 - RNA, 19 nt, Artificial Sequence
  Description of Artificial Sequence: Synthetic oligonucleotide
ucaaaacaguauuggcaca

SEQ ID NO: 2745 - RNA, 19 nt, Artificial Sequence
  Description of Artificial Sequence: Synthetic oligonucleotide
gugccaauacuguuuugau

SEQ ID NO: 2746 - RNA, 19 nt, Artificial Sequence
  Description of Artificial Sequence: Synthetic oligonucleotide
aucaaaacaguauuggcac

SEQ ID NO: 2747 - RNA, 19 nt, Artificial Sequence
  Description of Artificial Sequence: Synthetic oligonucleotide
gccaauacuguuuugauaa

SEQ ID NO: 2748 - RNA, 19 nt, Artificial Sequence
  Description of Artificial Sequence: Synthetic oligonucleotide
uuaucaaaacaguauuggc

SEQ ID NO: 2749 - RNA, 20 nt, Artificial Sequence
  Description of Artificial Sequence: Synthetic oligonucleotide
gucacugcuugcagccugag

SEQ ID NO: 2750 - RNA, 20 nt, Artificial Sequence
  Description of Artificial Sequence: Synthetic oligonucleotide
ugucacugcuugcagccuga

SEQ ID NO: 2751 - RNA, 20 nt, Artificial Sequence
  Description of Artificial Sequence: Synthetic oligonucleotide
cugucacugcuugcagccug

SEQ ID NO: 2752 - RNA, 20 nt, Artificial Sequence
  Description of Artificial Sequence: Synthetic oligonucleotide
acugucacugcuugcagccu

SEQ ID NO: 2753 - RNA, 20 nt, Artificial Sequence
  Description of Artificial Sequence: Synthetic oligonucleotide
cacugucacugcuugcagcc

SEQ ID NO: 2754 - RNA, 20 nt, Artificial Sequence
  Description of Artificial Sequence: Synthetic oligonucleotide
gcacugucacugcuugcagc

SEQ ID NO: 2755 - RNA, 20 nt, Artificial Sequence
  Description of Artificial Sequence: Synthetic oligonucleotide
ggcacugucacugcuugcag

SEQ ID NO: 2756 - RNA, 20 nt, Artificial Sequence
  Description of Artificial Sequence: Synthetic oligonucleotide
gggcacugucacugcuugca

SEQ ID NO: 2757 - RNA, 20 nt, Artificial Sequence
  Description of Artificial Sequence: Synthetic oligonucleotide
ugggcacugucacugcuugc

SEQ ID NO: 2758 - RNA, 20 nt, Artificial Sequence
  Description of Artificial Sequence: Synthetic oligonucleotide
ucucacacuuuacaagcugu

SEQ ID NO: 2759 - RNA, 20 nt, Artificial Sequence
  Description of Artificial Sequence: Synthetic oligonucleotide
gucucacacuuuacaagcug

SEQ ID NO: 2760 - RNA, 20 nt, Artificial Sequence
  Description of Artificial Sequence: Synthetic oligonucleotide
ugucucacacuuuacaagcu

SEQ ID NO: 2761 - RNA, 20 nt, Artificial Sequence
  Description of Artificial Sequence: Synthetic oligonucleotide
cugucucacacuuuacaagc

SEQ ID NO: 2762 - RNA, 20 nt, Artificial Sequence
  Description of Artificial Sequence: Synthetic oligonucleotide
gcugucucacacuuuacaag

SEQ ID NO: 2763 - RNA, 20 nt, Artificial Sequence
  Description of Artificial Sequence: Synthetic oligonucleotide
agcugucucacacuuuacaa

SEQ ID NO: 2764 - RNA, 19 nt, Artificial Sequence
  Description of Artificial Sequence: Synthetic oligonucleotide
ggcugcaagcagugacagu

SEQ ID NO: 2765 - RNA, 19 nt, Artificial Sequence
  Description of Artificial Sequence: Synthetic oligonucleotide
acugucacugcuugcagcc

SEQ ID NO: 2766 - RNA, 19 nt, Artificial Sequence
  Description of Artificial Sequence: Synthetic oligonucleotide
gcugcaagcagugacagug

SEQ ID NO: 2767 - RNA, 19 nt, Artificial Sequence
  Description of Artificial Sequence: Synthetic oligonucleotide
cacugucacugcuugcagc

SEQ ID NO: 2768 - RNA, 19 nt, Artificial Sequence
  Description of Artificial Sequence: Synthetic oligonucleotide
cugcaagcagugacagugc

SEQ ID NO: 2769 - RNA, 19 nt, Artificial Sequence
  Description of Artificial Sequence: Synthetic oligonucleotide
gcacugucacugcuugcag

SEQ ID NO: 2770 - RNA, 19 nt, Artificial Sequence
  Description of Artificial Sequence: Synthetic oligonucleotide
ugcaagcagugacagugcc

SEQ ID NO: 2771 - RNA, 19 nt, Artificial Sequence
  Description of Artificial Sequence: Synthetic oligonucleotide
ggcacugucacugcuugca

SEQ ID NO: 2772 - RNA, 19 nt, Artificial Sequence
  Description of Artificial Sequence: Synthetic oligonucleotide
gcaagcagugacagugccc

SEQ ID NO: 2773 - RNA, 19 nt, Artificial Sequence
  Description of Artificial Sequence: Synthetic oligonucleotide
gggcacugucacugcuugc

SEQ ID NO: 2774 - RNA, 19 nt, Artificial Sequence
  Description of Artificial Sequence: Synthetic oligonucleotide
caagcagugacagugccca

SEQ ID NO: 2775 - RNA, 19 nt, Artificial Sequence
  Description of Artificial Sequence: Synthetic oligonucleotide
ugggcacugucacugcuug

SEQ ID NO: 2776 - RNA, 19 nt, Artificial Sequence
  Description of Artificial Sequence: Synthetic oligonucleotide
cucacagcuuguaaagugu

SEQ ID NO: 2777 - RNA, 19 nt, Artificial Sequence
  Description of Artificial Sequence: Synthetic oligonucleotide
acacuuuacaagcugugag

SEQ ID NO: 2778 - RNA, 20 nt, Artificial Sequence
  Description of Artificial Sequence: Synthetic oligonucleotide
ugcacgcagccugagaguag

SEQ ID NO: 2779 - RNA, 20 nt, Artificial Sequence
  Description of Artificial Sequence: Synthetic oligonucleotide
cugcacgcagccugagagua

SEQ ID NO: 2780 - RNA, 19 nt, Artificial Sequence
  Description of Artificial Sequence: Synthetic oligonucleotide
cuacucucaggcugcgugc

SEQ ID NO: 2781 - RNA, 19 nt, Artificial Sequence
  Description of Artificial Sequence: Synthetic oligonucleotide
gcacgcagccugagaguag

SEQ ID NO: 2782 - RNA, 19 nt, Artificial Sequence
  Description of Artificial Sequence: Synthetic oligonucleotide
uacucucaggcugcgugca

SEQ ID NO: 2783 - RNA, 19 nt, Artificial Sequence
  Description of Artificial Sequence: Synthetic oligonucleotide
ugcacgcagccugagagua

SEQ ID NO: 2784 - RNA, 20 nt, Artificial Sequence
  Description of Artificial Sequence: Synthetic oligonucleotide
gcugucucaggcuuuacaag

SEQ ID NO: 2785 - RNA, 20 nt, Artificial Sequence
  Description of Artificial Sequence: Synthetic oligonucleotide
agcugucucaggcuuuacaa

SEQ ID NO: 2786 - RNA, 19 nt, Artificial Sequence
  Description of Artificial Sequence: Synthetic oligonucleotide
ugcucucaggcugcgugca

SEQ ID NO: 2787 - RNA, 19 nt, Artificial Sequence
  Description of Artificial Sequence: Synthetic oligonucleotide
ugcacgcagccugagagca

SEQ ID NO: 2788 - RNA, 20 nt, Artificial Sequence
  Antisense sequence
ugcagacaaggcucucggag

SEQ ID NO: 2789 - RNA, 20 nt, Artificial Sequence
  Antisense sequence
augcagacaaggcucucgga

SEQ ID NO: 2790 - RNA, 20 nt, Artificial Sequence
  Antisense sequence
aaugcagacaaggcucucgg

SEQ ID NO: 2791 - RNA, 20 nt, Artificial Sequence
  Antisense sequence
caaugcagacaaggcucucg

SEQ ID NO: 2792 - RNA, 20 nt, Artificial Sequence
  Antisense sequence
ccaaugcagacaaggcucuc

SEQ ID NO: 2793 - RNA, 20 nt, Artificial Sequence
  Antisense sequence
cccaaugcagacaaggcucu

SEQ ID NO: 2794 - RNA, 20 nt, Artificial Sequence
  Antisense sequence
agaagugaaacucgugggag

SEQ ID NO: 2795 - RNA, 20 nt, Artificial Sequence
  Antisense sequence
aagaagugaaacucguggga

SEQ ID NO: 2796 - RNA, 20 nt, Artificial Sequence
  Antisense sequence
gaagaagugaaacucguggg

SEQ ID NO: 2797 - RNA, 20 nt, Artificial Sequence
  Antisense sequence
agaagaagugaaacucgugg

SEQ ID NO: 2798 - RNA, 20 nt, Artificial Sequence
  Antisense sequence
gagaagaagugaaacucgug

SEQ ID NO: 2799 - RNA, 20 nt, Artificial Sequence
  Antisense sequence
ggagaagaagugaaacucgu

SEQ ID NO: 2800 - RNA, 20 nt, Artificial Sequence
  Antisense sequence
uugggagaagaagugaaacu

SEQ ID NO: 2801 - RNA, 20 nt, Artificial Sequence
  Antisense sequence
guugggagaagaagugaaac

SEQ ID NO: 2802 - RNA, 20 nt, Artificial Sequence
  Antisense sequence
agguugggagaagaagugaa

SEQ ID NO: 2803 - RNA, 20 nt, Artificial Sequence
  Antisense sequence
auagguugggagaagaagug

SEQ ID NO: 2804 - RNA, 20 nt, Artificial Sequence
  Antisense sequence
gacauagguugggagaagaa

SEQ ID NO: 2805 - RNA, 20 nt, Artificial Sequence
  Antisense sequence
cgacauagguugggagaaga

SEQ ID NO: 2806 - RNA, 20 nt, Artificial Sequence
  Antisense sequence
ccgacauagguugggagaag

SEQ ID NO: 2807 - RNA, 20 nt, Artificial Sequence
  Antisense sequence
cccgacauagguugggagaa

SEQ ID NO: 2808 - RNA, 20 nt, Artificial Sequence
  Antisense sequence
acccgacauagguugggaga

SEQ ID NO: 2809 - RNA, 20 nt, Artificial Sequence
  Antisense sequence
gacccgacauagguugggag

SEQ ID NO: 2810 - RNA, 20 nt, Artificial Sequence
  Antisense sequence
ggacccgacauagguuggga

SEQ ID NO: 2811 - RNA, 20 nt, Artificial Sequence
  Antisense sequence
aggacccgacauagguuggg

SEQ ID NO: 2812 - RNA, 20 nt, Artificial Sequence
  Antisense sequence
aaggacccgacauagguugg

SEQ ID NO: 2813 - RNA, 20 nt, Artificial Sequence
  Antisense sequence
gaaggacccgacauagguug

SEQ ID NO: 2814 - RNA, 20 nt, Artificial Sequence
  Antisense sequence
agaaggacccgacauagguu

SEQ ID NO: 2815 - RNA, 20 nt, Artificial Sequence
  Antisense sequence
aagaaggacccgacauaggu

SEQ ID NO: 2816 - RNA, 20 nt, Artificial Sequence
  Antisense sequence
gaagaaggacccgacauagg

SEQ ID NO: 2817 - RNA, 20 nt, Artificial Sequence
  Antisense sequence
ggaagaaggacccgacauag

SEQ ID NO: 2818 - RNA, 20 nt, Artificial Sequence
  Antisense sequence
uggaagaaggacccgacaua

SEQ ID NO: 2819 - RNA, 20 nt, Artificial Sequence
  Antisense sequence
cuggaagaaggacccgacau

SEQ ID NO: 2820 - RNA, 20 nt, Artificial Sequence
  Antisense sequence
ccuggaagaaggacccgaca

SEQ ID NO: 2821 - RNA, 20 nt, Artificial Sequence
  Antisense sequence
cacgaguauccuggaagaag

SEQ ID NO: 2822 - RNA, 20 nt, Artificial Sequence
  Antisense sequence
ucacgaguauccuggaagaa

SEQ ID NO: 2823 - RNA, 20 nt, Artificial Sequence
  Antisense sequence
gucacgaguauccuggaaga

SEQ ID NO: 2824 - RNA, 20 nt, Artificial Sequence
  Antisense sequence
cgucacgaguauccuggaag

SEQ ID NO: 2825 - RNA, 20 nt, Artificial Sequence
  Antisense sequence
cgcgucacgaguauccugga

SEQ ID NO: 2826 - RNA, 20 nt, Artificial Sequence
  Antisense sequence
acacccgacacccaauggga

SEQ ID NO: 2827 - RNA, 20 nt, Artificial Sequence
  Antisense sequence
agacacccgacacccaaugg

SEQ ID NO: 2828 - RNA, 20 nt, Artificial Sequence
  Antisense sequence
uagacacccgacacccaaug

SEQ ID NO: 2829 - RNA, 20 nt, Artificial Sequence
  Antisense sequence
cuagacacccgacacccaau

SEQ ID NO: 2830 - RNA, 20 nt, Artificial Sequence
  Antisense sequence
cggcgacacugauuggcuuc

SEQ ID NO: 2831 - RNA, 20 nt, Artificial Sequence
  Antisense sequence
ggacuuuagaacugggaccc

SEQ ID NO: 2832 - RNA, 20 nt, Artificial Sequence
  Antisense sequence
auucugaguccgggugggug

SEQ ID NO: 2833 - RNA, 20 nt, Artificial Sequence
  Antisense sequence
gauucugaguccgggugggu

SEQ ID NO: 2834 - RNA, 20 nt, Artificial Sequence
  Antisense sequence
agauucugaguccggguggg

SEQ ID NO: 2835 - RNA, 20 nt, Artificial Sequence
  Antisense sequence
gagauucugaguccgggugg

SEQ ID NO: 2836 - RNA, 20 nt, Artificial Sequence
  Antisense sequence
ggagauucugaguccgggug

SEQ ID NO: 2837 - RNA, 20 nt, Artificial Sequence
  Antisense sequence
aggagauucugaguccgggu

SEQ ID NO: 2838 - RNA, 20 nt, Artificial Sequence
  Antisense sequence
gaggagauucugaguccggg

SEQ ID NO: 2839 - RNA, 20 nt, Artificial Sequence
  Antisense sequence
ugaggagauucugaguccgg

SEQ ID NO: 2840 - RNA, 20 nt, Artificial Sequence
  Antisense sequence
ucugaggagauucugagucc

SEQ ID NO: 2841 - RNA, 20 nt, Artificial Sequence
  Antisense sequence
gucugaggagauucugaguc

SEQ ID NO: 2842 - RNA, 20 nt, Artificial Sequence
  Antisense sequence
cgucugaggagauucugagu

SEQ ID NO: 2843 - RNA, 20 nt, Artificial Sequence
  Antisense sequence
ggcgucugaggagauucuga

SEQ ID NO: 2844 - RNA, 20 nt, Artificial Sequence
  Antisense sequence
cggcgucugaggagauucug

SEQ ID NO: 2845 - RNA, 20 nt, Artificial Sequence
  Antisense sequence
ucggcgucugaggagauucu

SEQ ID NO: 2846 - RNA, 20 nt, Artificial Sequence
  Antisense sequence
cucggcgucugaggagauuc

SEQ ID NO: 2847 - RNA, 20 nt, Artificial Sequence
  Antisense sequence
uguggaaauaccucauggag

SEQ ID NO: 2848 - RNA, 20 nt, Artificial Sequence
  Antisense sequence
gguguggaaauaccucaugg

SEQ ID NO: 2849 - RNA, 20 nt, Artificial Sequence
  Antisense sequence
cacggagguguggaaauacc

SEQ ID NO: 2850 - RNA, 20 nt, Artificial Sequence
  Antisense sequence
uagcccacggugaugaagcg

SEQ ID NO: 2851 - RNA, 20 nt, Artificial Sequence
  Antisense sequence
guagcccacggugaugaagc

SEQ ID NO: 2852 - RNA, 20 nt, Artificial Sequence
  Antisense sequence
cguagcccacggugaugaag

SEQ ID NO: 2853 - RNA, 20 nt, Artificial Sequence
  Antisense sequence
acguagcccacggugaugaa

SEQ ID NO: 2854 - RNA, 20 nt, Artificial Sequence
  Antisense sequence
cacguagcccacggugauga

SEQ ID NO: 2855 - RNA, 20 nt, Artificial Sequence
  Antisense sequence
uccacguagcccacggugau

SEQ ID NO: 2856 - RNA, 20 nt, Artificial Sequence
  Antisense sequence
ucgaaccucacgaacagcgu

SEQ ID NO: 2857 - RNA, 20 nt, Artificial Sequence
  Antisense sequence
gucgaaccucacgaacagcg

SEQ ID NO: 2858 - RNA, 20 nt, Artificial Sequence
  Antisense sequence
ugucgaaccucacgaacagc

SEQ ID NO: 2859 - RNA, 20 nt, Artificial Sequence
  Antisense sequence
gcugucgaaccucacgaaca

SEQ ID NO: 2860 - RNA, 20 nt, Artificial Sequence
  Antisense sequence
cgcugucgaaccucacgaac

SEQ ID NO: 2861 - RNA, 20 nt, Artificial Sequence
  Antisense sequence
ucgcugucgaaccucacgaa

SEQ ID NO: 2862 - RNA, 20 nt, Artificial Sequence
  Antisense sequence
gucgcugucgaaccucacga

SEQ ID NO: 2863 - RNA, 20 nt, Artificial Sequence
  Antisense sequence
ucucccggucccaauacucc

SEQ ID NO: 2864 - RNA, 20 nt, Artificial Sequence
  Antisense sequence
aucugugucucccgguccca

SEQ ID NO: 2865 - RNA, 20 nt, Artificial Sequence
  Antisense sequence
gugccuuggccuugcagauc

SEQ ID NO: 2866 - RNA, 20 nt, Artificial Sequence
  Antisense sequence
gucugugccuuggccuugca

SEQ ID NO: 2867 - RNA, 20 nt, Artificial Sequence
  Antisense sequence
agucugugccuuggccuugc

SEQ ID NO: 2868 - RNA, 20 nt, Artificial Sequence
  Antisense sequence
cagucugugccuuggccuug

SEQ ID NO: 2869 - RNA, 20 nt, Artificial Sequence
  Antisense sequence
ucagucugugccuuggccuu

SEQ ID NO: 2870 - RNA, 20 nt, Artificial Sequence
  Antisense sequence
gucagucugugccuuggccu

SEQ ID NO: 2871 - RNA, 20 nt, Artificial Sequence
  Antisense sequence
ucggucagucugugccuugg

SEQ ID NO: 2872 - RNA, 20 nt, Artificial Sequence
  Antisense sequence
cucggucagucugugccuug

SEQ ID NO: 2873 - RNA, 20 nt, Artificial Sequence
  Antisense sequence
ucucggucagucugugccuu

SEQ ID NO: 2874 - RNA, 20 nt, Artificial Sequence
  Antisense sequence
cucucggucagucugugccu

SEQ ID NO: 2875 - RNA, 20 nt, Artificial Sequence
  Antisense sequence
uccucucggucagucugugc

SEQ ID NO: 2876 - RNA, 20 nt, Artificial Sequence
  Antisense sequence
guccucucggucagucugug

SEQ ID NO: 2877 - RNA, 20 nt, Artificial Sequence
  Antisense sequence
gguccucucggucagucugu

SEQ ID NO: 2878 - RNA, 20 nt, Artificial Sequence
  Antisense sequence
agguccucucggucagucug

SEQ ID NO: 2879 - RNA, 20 nt, Artificial Sequence
  Antisense sequence
cagguccucucggucagucu

SEQ ID NO: 2880 - RNA, 20 nt, Artificial Sequence
  Antisense sequence
uguaguagcggagcaggguc

SEQ ID NO: 2881 - RNA, 20 nt, Artificial Sequence
  Antisense sequence
uuguaguagcggagcagggu

SEQ ID NO: 2882 - RNA, 20 nt, Artificial Sequence
  Antisense sequence
guuguaguagcggagcaggg

SEQ ID NO: 2883 - RNA, 20 nt, Artificial Sequence
  Antisense sequence
gguuguaguagcggagcagg

SEQ ID NO: 2884 - RNA, 20 nt, Artificial Sequence
  Antisense sequence
ugguuguaguagcggagcag

SEQ ID NO: 2885 - RNA, 20 nt, Artificial Sequence
  Antisense sequence
cugguuguaguagcggagca

SEQ ID NO: 2886 - RNA, 20 nt, Artificial Sequence
  Antisense sequence
auucuggagggugugagacc

SEQ ID NO: 2887 - RNA, 20 nt, Artificial Sequence
  Antisense sequence
uauucuggagggugugagac

SEQ ID NO: 2888 - RNA, 20 nt, Artificial Sequence
  Antisense sequence
auauucuggagggugugaga

SEQ ID NO: 2889 - RNA, 20 nt, Artificial Sequence
  Antisense sequence
cauauucuggagggugugag

SEQ ID NO: 2890 - RNA, 20 nt, Artificial Sequence
  Antisense sequence
acauauucuggaggguguga

SEQ ID NO: 2891 - RNA, 20 nt, Artificial Sequence
  Antisense sequence
uacauauucuggagggugug

SEQ ID NO: 2892 - RNA, 20 nt, Artificial Sequence
  Antisense sequence
auacauauucuggagggugu

SEQ ID NO: 2893 - RNA, 20 nt, Artificial Sequence
  Antisense sequence
cauacauauucuggagggug

SEQ ID NO: 2894 - RNA, 20 nt, Artificial Sequence
  Antisense sequence
ccauacauauucuggagggu

SEQ ID NO: 2895 - RNA, 20 nt, Artificial Sequence
  Antisense sequence
gccauacauauucuggaggg

SEQ ID NO: 2896 - RNA, 20 nt, Artificial Sequence
  Antisense sequence
agccauacauauucuggagg

SEQ ID NO: 2897 - RNA, 20 nt, Artificial Sequence
  Antisense sequence
cagccauacauauucuggag

SEQ ID NO: 2898 - RNA, 20 nt, Artificial Sequence
  Antisense sequence
gcagccauacauauucugga

SEQ ID NO: 2899 - RNA, 20 nt, Artificial Sequence
  Antisense sequence
cgcagccauacauauucugg

SEQ ID NO: 2900 - RNA, 20 nt, Artificial Sequence
  Antisense sequence
ucgcagccauacauauucug

SEQ ID NO: 2901 - RNA, 20 nt, Artificial Sequence
  Antisense sequence
gucgcagccauacauauucu

SEQ ID NO: 2902 - RNA, 20 nt, Artificial Sequence
  Antisense sequence
cgucgcagccauacauauuc

SEQ ID NO: 2903 - RNA, 20 nt, Artificial Sequence
  Antisense sequence
acgucgcagccauacauauu

SEQ ID NO: 2904 - RNA, 20 nt, Artificial Sequence
  Antisense sequence
cacgucgcagccauacauau

SEQ ID NO: 2905 - RNA, 20 nt, Artificial Sequence
  Antisense sequence
ccacgucgcagccauacaua

SEQ ID NO: 2906 - RNA, 20 nt, Artificial Sequence
  Antisense sequence
ucguaggcguccugguggua

SEQ ID NO: 2907 - RNA, 20 nt, Artificial Sequence
  Antisense sequence
ccacuugcgcugggugaucu

SEQ ID NO: 2908 - RNA, 20 nt, Artificial Sequence
  Antisense sequence
aguuugguccucgccauccc

SEQ ID NO: 2909 - RNA, 20 nt, Artificial Sequence
  Antisense sequence
gaguuugguccucgccaucc

SEQ ID NO: 2910 - RNA, 20 nt, Artificial Sequence
  Antisense sequence
ugaguuugguccucgccauc

SEQ ID NO: 2911 - RNA, 20 nt, Artificial Sequence
  Antisense sequence
cugaguuugguccucgccau

SEQ ID NO: 2912 - RNA, 20 nt, Artificial Sequence
  Antisense sequence
guccugaguuugguccucgc

SEQ ID NO: 2913 - RNA, 20 nt, Artificial Sequence
  Antisense sequence
uguccugaguuugguccucg

SEQ ID NO: 2914 - RNA, 20 nt, Artificial Sequence
  Antisense sequence
guguccugaguuugguccuc

SEQ ID NO: 2915 - RNA, 20 nt, Artificial Sequence
  Antisense sequence
aguguccugaguuugguccu

SEQ ID NO: 2916 - RNA, 20 nt, Artificial Sequence
  Antisense sequence
caguguccugaguuuggucc

SEQ ID NO: 2917 - RNA, 20 nt, Artificial Sequence
  Antisense sequence
ggucuccacaagcucagugu

SEQ ID NO: 2918 - RNA, 20 nt, Artificial Sequence
  Antisense sequence
cuggucuccacaagcucagu

SEQ ID NO: 2919 - RNA, 20 nt, Artificial Sequence
  Antisense sequence
ucuggucuccacaagcucag

SEQ ID NO: 2920 - RNA, 20 nt, Artificial Sequence
  Antisense sequence
uggucuggucuccacaagcu

SEQ ID NO: 2921 - RNA, 20 nt, Artificial Sequence
  Antisense sequence
cuggucuggucuccacaagc

SEQ ID NO: 2922 - RNA, 20 nt, Artificial Sequence
  Antisense sequence
gcuggucuggucuccacaag

SEQ ID NO: 2923 - RNA, 20 nt, Artificial Sequence
  Antisense sequence
aucuccugcuggucuggucu

SEQ ID NO: 2924 - RNA, 20 nt, Artificial Sequence
  Antisense sequence
uaucuccugcuggucugguc

SEQ ID NO: 2925 - RNA, 20 nt, Artificial Sequence
  Antisense sequence
cuaucuccugcuggucuggu

SEQ ID NO: 2926 - RNA, 20 nt, Artificial Sequence
  Antisense sequence
ucuaucuccugcuggucugg

SEQ ID NO: 2927 - RNA, 20 nt, Artificial Sequence
  Antisense sequence
uucuaucuccugcuggucug

SEQ ID NO: 2928 - RNA, 20 nt, Artificial Sequence
  Antisense sequence
agguucuaucuccugcuggu

SEQ ID NO: 2929 - RNA, 20 nt, Artificial Sequence
  Antisense sequence
gaagguucuaucuccugcug

SEQ ID NO: 2930 - RNA, 20 nt, Artificial Sequence
  Antisense sequence
ggaagguucuaucuccugcu

SEQ ID NO: 2931 - RNA, 20 nt, Artificial Sequence
  Antisense sequence
uggaagguucuaucuccugc

SEQ ID NO: 2932 - RNA, 20 nt, Artificial Sequence
  Antisense sequence
cuggaagguucuaucuccug

SEQ ID NO: 2933 - RNA, 20 nt, Artificial Sequence
  Antisense sequence
ucuggaagguucuaucuccu

SEQ ID NO: 2934 - RNA, 20 nt, Artificial Sequence
  Antisense sequence
uucuggaagguucuaucucc

SEQ ID NO: 2935 - RNA, 20 nt, Artificial Sequence
  Antisense sequence
cuucuggaagguucuaucuc

SEQ ID NO: 2936 - RNA, 20 nt, Artificial Sequence
  Antisense sequence
acuucuggaagguucuaucu

SEQ ID NO: 2937 - RNA, 20 nt, Artificial Sequence
  Antisense sequence
ggcauguguaucucugcucu

SEQ ID NO: 2938 - RNA, 20 nt, Artificial Sequence
  Antisense sequence
aagacggcucccaucucagg

SEQ ID NO: 2939 - RNA, 20 nt, Artificial Sequence
  Antisense sequence
gaagacggcucccaucucag

SEQ ID NO: 2940 - RNA, 20 nt, Artificial Sequence
  Antisense sequence
ggaagacggcucccaucuca

SEQ ID NO: 2941 - RNA, 20 nt, Artificial Sequence
  Antisense sequence
aggccagcaacaaugcccac

SEQ ID NO: 2942 - RNA, 20 nt, Artificial Sequence
  Antisense sequence
cagccaggccagcaacaaug

SEQ ID NO: 2943 - RNA, 20 nt, Artificial Sequence
  Antisense sequence
caacugcuaggacagccagg

SEQ ID NO: 2944 - RNA, 20 nt, Artificial Sequence
  Antisense sequence
cacaacugcuaggacagcca

SEQ ID NO: 2945 - RNA, 20 nt, Artificial Sequence
  Antisense sequence
ccacaacugcuaggacagcc

SEQ ID NO: 2946 - RNA, 20 nt, Artificial Sequence
  Antisense sequence
accacaacugcuaggacagc

SEQ ID NO: 2947 - RNA, 20 nt, Artificial Sequence
  Antisense sequence
gaccacaacugcuaggacag

SEQ ID NO: 2948 - RNA, 20 nt, Artificial Sequence
  Antisense sequence
ugaccacaacugcuaggaca

SEQ ID NO: 2949 - RNA, 20 nt, Artificial Sequence
  Antisense sequence
gaugaccacaacugcuagga

SEQ ID NO: 2950 - RNA, 20 nt, Artificial Sequence
  Antisense sequence
cgaugaccacaacugcuagg

SEQ ID NO: 2951 - RNA, 20 nt, Artificial Sequence
  Antisense sequence
uccgaugaccacaacugcua

SEQ ID NO: 2952 - RNA, 20 nt, Artificial Sequence
  Antisense sequence
cuccgaugaccacaacugcu

SEQ ID NO: 2953 - RNA, 20 nt, Artificial Sequence
  Antisense sequence
gcuccgaugaccacaacugc

SEQ ID NO: 2954 - RNA, 20 nt, Artificial Sequence
  Antisense sequence
agcuccgaugaccacaacug

SEQ ID NO: 2955 - RNA, 20 nt, Artificial Sequence
  Antisense sequence
cagcuccgaugaccacaacu

SEQ ID NO: 2956 - RNA, 20 nt, Artificial Sequence
  Antisense sequence
acagcuccgaugaccacaac

SEQ ID NO: 2957 - RNA, 20 nt, Artificial Sequence
  Antisense sequence
cacagcuccgaugaccacaa

SEQ ID NO: 2958 - RNA, 20 nt, Artificial Sequence
  Antisense sequence
ccacagcuccgaugaccaca

SEQ ID NO: 2959 - RNA, 20 nt, Artificial Sequence
  Antisense sequence
accacagcuccgaugaccac

SEQ ID NO: 2960 - RNA, 20 nt, Artificial Sequence
  Antisense sequence
gaccacagcuccgaugacca

SEQ ID NO: 2961 - RNA, 20 nt, Artificial Sequence
  Antisense sequence
agcgaccacagcuccgauga

SEQ ID NO: 2962 - RNA, 20 nt, Artificial Sequence
  Antisense sequence
uccuacacaucacagcagcg

SEQ ID NO: 2963 - RNA, 20 nt, Artificial Sequence
  Antisense sequence
cuccuacacaucacagcagc

SEQ ID NO: 2964 - RNA, 20 nt, Artificial Sequence
  Antisense sequence
ccuccuacacaucacagcag

SEQ ID NO: 2965 - RNA, 20 nt, Artificial Sequence
  Antisense sequence
uccuccuacacaucacagca

SEQ ID NO: 2966 - RNA, 20 nt, Artificial Sequence
  Antisense sequence
uuccuccuacacaucacagc

SEQ ID NO: 2967 - RNA, 20 nt, Artificial Sequence
  Antisense sequence
ucuuccuccuacacaucaca

SEQ ID NO: 2968 - RNA, 20 nt, Artificial Sequence
  Antisense sequence
ccuccuuuuccaccugagcu

SEQ ID NO: 2969 - RNA, 20 nt, Artificial Sequence
  Antisense sequence
cccuccuuuuccaccugagc

SEQ ID NO: 2970 - RNA, 20 nt, Artificial Sequence
  Antisense sequence
ugcacgcagccugagaguag

SEQ ID NO: 2971 - RNA, 20 nt, Artificial Sequence
  Antisense sequence
cugcacgcagccugagagua

SEQ ID NO: 2972 - RNA, 20 nt, Artificial Sequence
  Antisense sequence
uuucaagcugugagagacac

SEQ ID NO: 2973 - RNA, 20 nt, Artificial Sequence
  Antisense sequence
accuuuucaagcugugagag

SEQ ID NO: 2974 - RNA, 20 nt, Artificial Sequence
  Antisense sequence
caccuuuucaagcugugaga

SEQ ID NO: 2975 - RNA, 20 nt, Artificial Sequence
  Antisense sequence
gaaucuccauuacccaggcc

SEQ ID NO: 2976 - RNA, 20 nt, Artificial Sequence
  Antisense sequence
agaaucuccauuacccaggc

SEQ ID NO: 2977 - RNA, 20 nt, Artificial Sequence
  Antisense sequence
aagaaucuccauuacccagg

SEQ ID NO: 2978 - RNA, 20 nt, Artificial Sequence
  Antisense sequence
aaagaaucuccauuacccag

SEQ ID NO: 2979 - RNA, 20 nt, Artificial Sequence
  Antisense sequence
caaagaaucuccauuaccca

SEQ ID NO: 2980 - RNA, 20 nt, Artificial Sequence
  Antisense sequence
cccaaucaaagaaucuccau

SEQ ID NO: 2981 - RNA, 20 nt, Artificial Sequence
  Antisense sequence
ucccaaucaaagaaucucca

SEQ ID NO: 2982 - RNA, 20 nt, Artificial Sequence
  Antisense sequence
aucccaaucaaagaaucucc

SEQ ID NO: 2983 - RNA, 20 nt, Artificial Sequence
  Antisense sequence
caucccaaucaaagaaucuc

SEQ ID NO: 2984 - RNA, 20 nt, Artificial Sequence
  Antisense sequence
cgaaacaucccaaucaaaga

SEQ ID NO: 2985 - RNA, 20 nt, Artificial Sequence
  Antisense sequence
cacgcgaaacaucccaauca

SEQ ID NO: 2986 - RNA, 20 nt, Artificial Sequence
  Antisense sequence
acacgcgaaacaucccaauc

SEQ ID NO: 2987 - RNA, 20 nt, Artificial Sequence
  Antisense sequence
cacacgcgaaacaucccaau

SEQ ID NO: 2988 - RNA, 20 nt, Artificial Sequence
  Antisense sequence
acacacgcgaaacaucccaa

SEQ ID NO: 2989 - RNA, 20 nt, Artificial Sequence
  Antisense sequence
cacacacgcgaaacauccca

SEQ ID NO: 2990 - RNA, 20 nt, Artificial Sequence
  Antisense sequence
ccacacacgcgaaacauccc

SEQ ID NO: 2991 - RNA, 20 nt, Artificial Sequence
  Antisense sequence
accacacacgcgaaacaucc

SEQ ID NO: 2992 - RNA, 20 nt, Artificial Sequence
  Antisense sequence
caccacacacgcgaaacauc

SEQ ID NO: 2993 - RNA, 20 nt, Artificial Sequence
  Antisense sequence
cccaccacacacgcgaaaca

SEQ ID NO: 2994 - RNA, 20 nt, Artificial Sequence
  Antisense sequence
agcccaccacacacgcgaaa

SEQ ID NO: 2995 - RNA, 20 nt, Artificial Sequence
  Antisense sequence
aaacagcccaccacacacgc

SEQ ID NO: 2996 - RNA, 20 nt, Artificial Sequence
  Antisense sequence
uaaacagcccaccacacacg

SEQ ID NO: 2997 - RNA, 20 nt, Artificial Sequence
  Antisense sequence
ucuaaacagcccaccacaca

SEQ ID NO: 2998 - RNA, 20 nt, Artificial Sequence
  Antisense sequence
gucuaaacagcccaccacac

SEQ ID NO: 2999 - RNA, 20 nt, Artificial Sequence
  Antisense sequence
agucuaaacagcccaccaca

SEQ ID NO: 3000 - RNA, 20 nt, Artificial Sequence
  Antisense sequence
cagucuaaacagcccaccac

SEQ ID NO: 3001 - RNA, 20 nt, Artificial Sequence
  Antisense sequence
acagucuaaacagcccacca

SEQ ID NO: 3002 - RNA, 20 nt, Artificial Sequence
  Antisense sequence
ugacagucuaaacagcccac

SEQ ID NO: 3003 - RNA, 20 nt, Artificial Sequence
  Antisense sequence
augacagucuaaacagccca

SEQ ID NO: 3004 - RNA, 20 nt, Artificial Sequence
  Antisense sequence
gaugacagucuaaacagccc

SEQ ID NO: 3005 - RNA, 20 nt, Artificial Sequence
  Antisense sequence
ugaugacagucuaaacagcc

SEQ ID NO: 3006 - RNA, 20 nt, Artificial Sequence
  Antisense sequence
gugaugacagucuaaacagc

SEQ ID NO: 3007 - RNA, 20 nt, Artificial Sequence
  Antisense sequence
agugaugacagucuaaacag

SEQ ID NO: 3008 - RNA, 20 nt, Artificial Sequence
  Antisense sequence
augguaagugaugacagucu

SEQ ID NO: 3009 - RNA, 20 nt, Artificial Sequence
  Antisense sequence
caugguaagugaugacaguc

SEQ ID NO: 3010 - RNA, 20 nt, Artificial Sequence
  Antisense sequence
guuagucaugguaagugaug

SEQ ID NO: 3011 - RNA, 20 nt, Artificial Sequence
  Antisense sequence
gguuagucaugguaagugau

SEQ ID NO: 3012 - RNA, 20 nt, Artificial Sequence
  Antisense sequence
ugguuagucaugguaaguga

SEQ ID NO: 3013 - RNA, 20 nt, Artificial Sequence
  Antisense sequence
uucugguuagucaugguaag

SEQ ID NO: 3014 - RNA, 20 nt, Artificial Sequence
  Antisense sequence
ggcgugaagaaauccugcau

SEQ ID NO: 3015 - RNA, 20 nt, Artificial Sequence
  Antisense sequence
aggcgugaagaaauccugca

SEQ ID NO: 3016 - RNA, 20 nt, Artificial Sequence
  Antisense sequence
gaggcgugaagaaauccugc

SEQ ID NO: 3017 - RNA, 20 nt, Artificial Sequence
  Antisense sequence
ggaggcgugaagaaauccug

SEQ ID NO: 3018 - RNA, 20 nt, Artificial Sequence
  Antisense sequence
gggaggcgugaagaaauccu

SEQ ID NO: 3019 - RNA, 20 nt, Artificial Sequence
  Antisense sequence
gacgcagacacauucaggug

SEQ ID NO: 3020 - RNA, 20 nt, Artificial Sequence
  Antisense sequence
ggacgcagacacauucaggu

SEQ ID NO: 3021 - RNA, 20 nt, Artificial Sequence
  Antisense sequence
agggacgcagacacauucag

SEQ ID NO: 3022 - RNA, 20 nt, Artificial Sequence
  Antisense sequence
cagggacgcagacacauuca

SEQ ID NO: 3023 - RNA, 20 nt, Artificial Sequence
  Antisense sequence
acagggacgcagacacauuc

SEQ ID NO: 3024 - RNA, 20 nt, Artificial Sequence
  Antisense sequence
uaacagggacgcagacacau

SEQ ID NO: 3025 - RNA, 20 nt, Artificial Sequence
  Antisense sequence
augcuaacagggacgcagac

SEQ ID NO: 3026 - RNA, 20 nt, Artificial Sequence
  Antisense sequence
uaugcuaacagggacgcaga

SEQ ID NO: 3027 - RNA, 20 nt, Artificial Sequence
  Antisense sequence
uuaugcuaacagggacgcag

SEQ ID NO: 3028 - RNA, 20 nt, Artificial Sequence
  Antisense sequence
auuaugcuaacagggacgca

SEQ ID NO: 3029 - RNA, 20 nt, Artificial Sequence
  Antisense sequence
cauuaugcuaacagggacgc

SEQ ID NO: 3030 - RNA, 20 nt, Artificial Sequence
  Antisense sequence
acauuaugcuaacagggacg

SEQ ID NO: 3031 - RNA, 20 nt, Artificial Sequence
  Antisense sequence
cacauuaugcuaacagggac

SEQ ID NO: 3032 - RNA, 20 nt, Artificial Sequence
  Antisense sequence
ggaaacacaggucagcaugg

SEQ ID NO: 3033 - RNA, 20 nt, Artificial Sequence
  Antisense sequence
ggaggaaacacaggucagca

SEQ ID NO: 3034 - RNA, 20 nt, Artificial Sequence
  Antisense sequence
gggaggaaacacaggucagc

SEQ ID NO: 3035 - RNA, 20 nt, Artificial Sequence
  Antisense sequence
gaacaggaaagaugacuggg

SEQ ID NO: 3036 - RNA, 20 nt, Artificial Sequence
  Antisense sequence
gcacauaaaguugagacaga

SEQ ID NO: 3037 - RNA, 20 nt, Artificial Sequence
  Antisense sequence
ugcacauaaaguugagacag

SEQ ID NO: 3038 - RNA, 20 nt, Artificial Sequence
  Antisense sequence
caguagggaaguaagaaguu

SEQ ID NO: 3039 - RNA, 20 nt, Artificial Sequence
  Antisense sequence
auccaucaaccucucauagc

SEQ ID NO: 3040 - RNA, 20 nt, Artificial Sequence
  Antisense sequence
ugcucucucaaauuccagga

SEQ ID NO: 3041 - RNA, 20 nt, Artificial Sequence
  Antisense sequence
ugcagauucuggaagguucu

SEQ ID NO: 3042 - RNA, 20 nt, Artificial Sequence
  Antisense sequence
augcagauucuggaagguuc

SEQ ID NO: 3043 - RNA, 20 nt, Artificial Sequence
  Antisense sequence
agcgaacaugcagauucugg

SEQ ID NO: 3044 - RNA, 20 nt, Artificial Sequence
  Antisense sequence
acagcgaacaugcagauucu

SEQ ID NO: 3045 - RNA, 20 nt, Artificial Sequence
  Antisense sequence
cacagcgaacaugcagauuc

SEQ ID NO: 3046 - RNA, 20 nt, Artificial Sequence
  Antisense sequence
caacaccaaaugggcacagg

SEQ ID NO: 3047 - RNA, 20 nt, Artificial Sequence
  Antisense sequence
ucaacaccaaaugggcacag

SEQ ID NO: 3048 - RNA, 20 nt, Artificial Sequence
  Antisense sequence
cucaacaccaaaugggcaca

SEQ ID NO: 3049 - RNA, 20 nt, Artificial Sequence
  Antisense sequence
ggacucaacaccaaaugggc

SEQ ID NO: 3050 - RNA, 20 nt, Artificial Sequence
  Antisense sequence
gauggacucaacaccaaaug

SEQ ID NO: 3051 - RNA, 20 nt, Artificial Sequence
  Antisense sequence
caugauggacucaacaccaa

SEQ ID NO: 3052 - RNA, 20 nt, Artificial Sequence
  Antisense sequence
ccaugauggacucaacacca

SEQ ID NO: 3053 - RNA, 20 nt, Artificial Sequence
  Antisense sequence
cccaugauggacucaacacc

SEQ ID NO: 3054 - RNA, 20 nt, Artificial Sequence
  Antisense sequence
gcccaugauggacucaacac

SEQ ID NO: 3055 - RNA, 20 nt, Artificial Sequence
  Antisense sequence
aagcccaugauggacucaac

SEQ ID NO: 3056 - RNA, 20 nt, Artificial Sequence
  Antisense sequence
aaagcccaugauggacucaa

SEQ ID NO: 3057 - RNA, 20 nt, Artificial Sequence
  Antisense sequence
auaaagcccaugauggacuc

SEQ ID NO: 3058 - RNA, 20 nt, Artificial Sequence
  Antisense sequence
cauaaagcccaugauggacu

SEQ ID NO: 3059 - RNA, 20 nt, Artificial Sequence
  Antisense sequence
acauaaagcccaugauggac

SEQ ID NO: 3060 - RNA, 20 nt, Artificial Sequence
  Antisense sequence
cacauaaagcccaugaugga

SEQ ID NO: 3061 - RNA, 20 nt, Artificial Sequence
  Antisense sequence
ccacauaaagcccaugaugg

SEQ ID NO: 3062 - RNA, 20 nt, Artificial Sequence
  Antisense sequence
aaccacauaaagcccaugau

SEQ ID NO: 3063 - RNA, 20 nt, Artificial Sequence
  Antisense sequence
uaaccacauaaagcccauga

SEQ ID NO: 3064 - RNA, 20 nt, Artificial Sequence
  Antisense sequence
gacuaaccacauaaagccca

SEQ ID NO: 3065 - RNA, 20 nt, Artificial Sequence
  Antisense sequence
ggacuaaccacauaaagccc

SEQ ID NO: 3066 - RNA, 20 nt, Artificial Sequence
  Antisense sequence
aggacuaaccacauaaagcc

SEQ ID NO: 3067 - RNA, 20 nt, Artificial Sequence
  Antisense sequence
gaggacuaaccacauaaagc

SEQ ID NO: 3068 - RNA, 20 nt, Artificial Sequence
  Antisense sequence
ugaggacuaaccacauaaag

SEQ ID NO: 3069 - RNA, 20 nt, Artificial Sequence
  Antisense sequence
cugaggacuaaccacauaaa

SEQ ID NO: 3070 - RNA, 20 nt, Artificial Sequence
  Antisense sequence
gcugaggacuaaccacauaa

SEQ ID NO: 3071 - RNA, 20 nt, Artificial Sequence
  Antisense sequence
agcugaggacuaaccacaua

SEQ ID NO: 3072 - RNA, 20 nt, Artificial Sequence
  Antisense sequence
cucccgcuggacaaguuucc

SEQ ID NO: 3073 - RNA, 20 nt, Artificial Sequence
  Antisense sequence
gcucccgcuggacaaguuuc

SEQ ID NO: 3074 - RNA, 20 nt, Artificial Sequence
  Antisense sequence
agcucccgcuggacaaguuu

SEQ ID NO: 3075 - RNA, 20 nt, Artificial Sequence
  Antisense sequence
augugugagccucugugguc

SEQ ID NO: 3076 - RNA, 20 nt, Artificial Sequence
  Antisense sequence
gaugugugagccucuguggu

SEQ ID NO: 3077 - RNA, 20 nt, Artificial Sequence
  Antisense sequence
ggcgaugugugagccucugu

SEQ ID NO: 3078 - RNA, 20 nt, Artificial Sequence
  Antisense sequence
agggcgaugugugagccucu

SEQ ID NO: 3079 - RNA, 20 nt, Artificial Sequence
  Antisense sequence
uuugucucagaaugcacaga

SEQ ID NO: 3080 - RNA, 20 nt, Artificial Sequence
  Antisense sequence
auuugucucagaaugcacag

SEQ ID NO: 3081 - RNA, 20 nt, Artificial Sequence
  Antisense sequence
gaggugaauggcucugaaaa

SEQ ID NO: 3082 - RNA, 20 nt, Artificial Sequence
  Antisense sequence
gggcaagaggugaauggcuc

SEQ ID NO: 3083 - RNA, 20 nt, Artificial Sequence
  Antisense sequence
agggcaagaggugaauggcu

SEQ ID NO: 3084 - RNA, 20 nt, Artificial Sequence
  Antisense sequence
gcagggcaagaggugaaugg

SEQ ID NO: 3085 - RNA, 20 nt, Artificial Sequence
  Antisense sequence
uagaagcagggcaagaggug

SEQ ID NO: 3086 - RNA, 20 nt, Artificial Sequence
  Antisense sequence
cuagaagcagggcaagaggu

SEQ ID NO: 3087 - RNA, 20 nt, Artificial Sequence
  Antisense sequence
gagcagagcagaaaaggagc

SEQ ID NO: 3088 - RNA, 20 nt, Artificial Sequence
  Antisense sequence
ucacuagaaccagggcaggg

SEQ ID NO: 3089 - RNA, 20 nt, Artificial Sequence
  Antisense sequence
aucacuagaaccagggcagg

SEQ ID NO: 3090 - RNA, 20 nt, Artificial Sequence
  Antisense sequence
gaucacuagaaccagggcag

SEQ ID NO: 3091 - RNA, 20 nt, Artificial Sequence
  Antisense sequence
agaucacuagaaccagggca

SEQ ID NO: 3092 - RNA, 20 nt, Artificial Sequence
  Antisense sequence
aagaucacuagaaccagggc

SEQ ID NO: 3093 - RNA, 20 nt, Artificial Sequence
  Antisense sequence
caagaucacuagaaccaggg

SEQ ID NO: 3094 - RNA, 20 nt, Artificial Sequence
  Antisense sequence
ccaagaucacuagaaccagg

SEQ ID NO: 3095 - RNA, 20 nt, Artificial Sequence
  Antisense sequence
accaagaucacuagaaccag

SEQ ID NO: 3096 - RNA, 20 nt, Artificial Sequence
  Antisense sequence
caccaagaucacuagaacca

SEQ ID NO: 3097 - RNA, 20 nt, Artificial Sequence
  Antisense sequence
gcaccaagaucacuagaacc

SEQ ID NO: 3098 - RNA, 20 nt, Artificial Sequence
  Antisense sequence
agcaccaagaucacuagaac

SEQ ID NO: 3099 - RNA, 20 nt, Artificial Sequence
  Antisense sequence
cagcaccaagaucacuagaa

SEQ ID NO: 3100 - RNA, 20 nt, Artificial Sequence
  Antisense sequence
auucagcaccaagaucacua

SEQ ID NO: 3101 - RNA, 20 nt, Artificial Sequence
  Antisense sequence
ugggauuggauucagcacca

SEQ ID NO: 3102 - RNA, 20 nt, Artificial Sequence
  Antisense sequence
guugggauuggauucagcac

SEQ ID NO: 3103 - RNA, 20 nt, Artificial Sequence
  Antisense sequence
aguugggauuggauucagca

SEQ ID NO: 3104 - RNA, 20 nt, Artificial Sequence
  Antisense sequence
gaguugggauuggauucagc

SEQ ID NO: 3105 - RNA, 20 nt, Artificial Sequence
  Antisense sequence
ugaguugggauuggauucag

SEQ ID NO: 3106 - RNA, 20 nt, Artificial Sequence
  Antisense sequence
augaguugggauuggauuca

SEQ ID NO: 3107 - RNA, 20 nt, Artificial Sequence
  Antisense sequence
caugaguugggauuggauuc

SEQ ID NO: 3108 - RNA, 20 nt, Artificial Sequence
  Antisense sequence
gguccaauuucacagacaaa

SEQ ID NO: 3109 - RNA, 20 nt, Artificial Sequence
  Antisense sequence
cggguccaauuucacagaca

SEQ ID NO: 3110 - RNA, 20 nt, Artificial Sequence
  Antisense sequence
acggguccaauuucacagac

SEQ ID NO: 3111 - RNA, 20 nt, Artificial Sequence
  Antisense sequence
gacggguccaauuucacaga

SEQ ID NO: 3112 - RNA, 20 nt, Artificial Sequence
  Antisense sequence
ugacggguccaauuucacag

SEQ ID NO: 3113 - RNA, 20 nt, Artificial Sequence
  Antisense sequence
augacggguccaauuucaca

SEQ ID NO: 3114 - RNA, 20 nt, Artificial Sequence
  Antisense sequence
gaugacggguccaauuucac

SEQ ID NO: 3115 - RNA, 20 nt, Artificial Sequence
  Antisense sequence
ugaugacggguccaauuuca

SEQ ID NO: 3116 - RNA, 20 nt, Artificial Sequence
  Antisense sequence
uugaugacggguccaauuuc

SEQ ID NO: 3117 - RNA, 20 nt, Artificial Sequence
  Antisense sequence
cuugaugacggguccaauuu

SEQ ID NO: 3118 - RNA, 20 nt, Artificial Sequence
  Antisense sequence
ccuugaugacggguccaauu

SEQ ID NO: 3119 - RNA, 20 nt, Artificial Sequence
  Antisense sequence
uccuugaugacggguccaau

SEQ ID NO: 3120 - RNA, 20 nt, Artificial Sequence
  Antisense sequence
guccuugaugacggguccaa

SEQ ID NO: 3121 - RNA, 20 nt, Artificial Sequence
  Antisense sequence
aguccuugaugacgggucca

SEQ ID NO: 3122 - RNA, 20 nt, Artificial Sequence
  Antisense sequence
caguccuugaugacgggucc

SEQ ID NO: 3123 - RNA, 20 nt, Artificial Sequence
  Antisense sequence
acaguccuugaugacggguc

SEQ ID NO: 3124 - RNA, 20 nt, Artificial Sequence
  Antisense sequence
aacaguccuugaugacgggu

SEQ ID NO: 3125 - RNA, 20 nt, Artificial Sequence
  Antisense sequence
gaacaguccuugaugacggg

SEQ ID NO: 3126 - RNA, 20 nt, Artificial Sequence
  Antisense sequence
aaagaacaguccuugaugac

SEQ ID NO: 3127 - RNA, 20 nt, Artificial Sequence
  Antisense sequence
gaaagaacaguccuugauga

SEQ ID NO: 3128 - RNA, 20 nt, Artificial Sequence
  Antisense sequence
caaucagguucucucuucag

SEQ ID NO: 3129 - RNA, 20 nt, Artificial Sequence
  Antisense sequence
cacaaucagguucucucuuc

SEQ ID NO: 3130 - RNA, 20 nt, Artificial Sequence
  Antisense sequence
agcacacaaucagguucucu

SEQ ID NO: 3131 - RNA, 20 nt, Artificial Sequence
  Antisense sequence
gcagcacacaaucagguucu

SEQ ID NO: 3132 - RNA, 20 nt, Artificial Sequence
  Antisense sequence
ugcagcacacaaucagguuc

SEQ ID NO: 3133 - RNA, 19 nt, Artificial Sequence
  siRNA Sense Sequence
agagccuugucugcauugg

SEQ ID NO: 3134 - RNA, 19 nt, Artificial Sequence
  siRNA Antisense Sequence
ccaaugcagacaaggcucu

SEQ ID NO: 3135 - RNA, 19 nt, Artificial Sequence
  siRNA Sense Sequence
gagccuugucugcauuggg

SEQ ID NO: 3136 - RNA, 19 nt, Artificial Sequence
  siRNA Antisense Sequence
cccaaugcagacaaggcuc

SEQ ID NO: 3137 - RNA, 19 nt, Artificial Sequence
  siRNA Sense Sequence
cucccacgaguuucacuuc

SEQ ID NO: 3138 - RNA, 19 nt, Artificial Sequence
  siRNA Antisense Sequence
gaagugaaacucgugggag

SEQ ID NO: 3139 - RNA, 19 nt, Artificial Sequence
  siRNA Sense Sequence
ucccacgaguuucacuucu

SEQ ID NO: 3140 - RNA, 19 nt, Artificial Sequence
  siRNA Antisense Sequence
agaagugaaacucguggga

SEQ ID NO: 3141 - RNA, 19 nt, Artificial Sequence
  siRNA Sense Sequence
cccacgaguuucacuucuu

SEQ ID NO: 3142 - RNA, 19 nt, Artificial Sequence
  siRNA Antisense Sequence
aagaagugaaacucguggg

SEQ ID NO: 3143 - RNA, 19 nt, Artificial Sequence
  siRNA Sense Sequence
ccacgaguuucacuucuuc

SEQ ID NO: 3144 - RNA, 19 nt, Artificial Sequence
  siRNA Antisense Sequence
gaagaagugaaacucgugg

SEQ ID NO: 3145 - RNA, 19 nt, Artificial Sequence
  siRNA Sense Sequence
cacgaguuucacuucuucu

SEQ ID NO: 3146 - RNA, 19 nt, Artificial Sequence
  siRNA Antisense Sequence
agaagaagugaaacucgug

SEQ ID NO: 3147 - RNA, 19 nt, Artificial Sequence
  siRNA Sense Sequence
acgaguuucacuucuucuc

SEQ ID NO: 3148 - RNA, 19 nt, Artificial Sequence
  siRNA Antisense Sequence
gagaagaagugaaacucgu

SEQ ID NO: 3149 - RNA, 19 nt, Artificial Sequence
  siRNA Sense Sequence
cgaguuucacuucuucucc

SEQ ID NO: 3150 - RNA, 19 nt, Artificial Sequence
  siRNA Antisense Sequence
ggagaagaagugaaacucg

SEQ ID NO: 3151 - RNA, 19 nt, Artificial Sequence
  siRNA Sense Sequence
gaguuucacuucuucuccc

SEQ ID NO: 3152 - RNA, 19 nt, Artificial Sequence
  siRNA Antisense Sequence
gggagaagaagugaaacuc

SEQ ID NO: 3153 - RNA, 19 nt, Artificial Sequence
  siRNA Sense Sequence
acuucuucucccaaccuau

SEQ ID NO: 3154 - RNA, 19 nt, Artificial Sequence
  siRNA Antisense Sequence
auagguugggagaagaagu

SEQ ID NO: 3155 - RNA, 19 nt, Artificial Sequence
  siRNA Sense Sequence
cuucuucucccaaccuaug

SEQ ID NO: 3156 - RNA, 19 nt, Artificial Sequence
  siRNA Antisense Sequence
cauagguugggagaagaag

SEQ ID NO: 3157 - RNA, 19 nt, Artificial Sequence
  siRNA Sense Sequence
uucucccaaccuaugucgg

SEQ ID NO: 3158 - RNA, 19 nt, Artificial Sequence
  siRNA Antisense Sequence
ccgacauagguugggagaa

SEQ ID NO: 3159 - RNA, 19 nt, Artificial Sequence
  siRNA Sense Sequence
ucucccaaccuaugucggg

SEQ ID NO: 3160 - RNA, 19 nt, Artificial Sequence
  siRNA Antisense Sequence
cccgacauagguugggaga

SEQ ID NO: 3161 - RNA, 19 nt, Artificial Sequence
  siRNA Sense Sequence
cucccaaccuaugucgggu

SEQ ID NO: 3162 - RNA, 19 nt, Artificial Sequence
  siRNA Antisense Sequence
acccgacauagguugggag

SEQ ID NO: 3163 - RNA, 19 nt, Artificial Sequence
  siRNA Sense Sequence
ucccaaccuaugucggguc

SEQ ID NO: 3164 - RNA, 19 nt, Artificial Sequence
  siRNA Antisense Sequence
gacccgacauagguuggga

SEQ ID NO: 3165 - RNA, 19 nt, Artificial Sequence
  siRNA Sense Sequence
aaccuaugucggguccuuc

SEQ ID NO: 3166 - RNA, 19 nt, Artificial Sequence
  siRNA Antisense Sequence
gaaggacccgacauagguu

SEQ ID NO: 3167 - RNA, 19 nt, Artificial Sequence
  siRNA Sense Sequence
accuaugucggguccuucu

SEQ ID NO: 3168 - RNA, 19 nt, Artificial Sequence
  siRNA Antisense Sequence
agaaggacccgacauaggu

SEQ ID NO: 3169 - RNA, 19 nt, Artificial Sequence
  siRNA Sense Sequence
ccuaugucggguccuucuu

SEQ ID NO: 3170 - RNA, 19 nt, Artificial Sequence
  siRNA Antisense Sequence
aagaaggacccgacauagg

SEQ ID NO: 3171 - RNA, 19 nt, Artificial Sequence
  siRNA Sense Sequence
cuaugucggguccuucuuc

SEQ ID NO: 3172 - RNA, 19 nt, Artificial Sequence
  siRNA Antisense Sequence
gaagaaggacccgacauag

SEQ ID NO: 3173 - RNA, 19 nt, Artificial Sequence
  siRNA Sense Sequence
gucggguccuucuuccagg

SEQ ID NO: 3174 - RNA, 19 nt, Artificial Sequence
  siRNA Antisense Sequence
ccuggaagaaggacccgac

SEQ ID NO: 3175 - RNA, 19 nt, Artificial Sequence
  siRNA Antisense Sequence
uucuuccaggauacucgug

SEQ ID NO: 3176 - RNA, 19 nt, Artificial Sequence
  siRNA Antisense Sequence
cacgaguauccuggaagaa

SEQ ID NO: 3177 - RNA, 19 nt, Artificial Sequence
  siRNA Sense Sequence
ucuuccaggauacucguga

SEQ ID NO: 3178 - RNA, 19 nt, Artificial Sequence
  siRNA Antisense Sequence
ucacgaguauccuggaaga

SEQ ID NO: 3179 - RNA, 19 nt, Artificial Sequence
  siRNA Sense Sequence
cuuccaggauacucgugac

SEQ ID NO: 3180 - RNA, 19 nt, Artificial Sequence
  siRNA Antisense Sequence
gucacgaguauccuggaag

SEQ ID NO: 3181 - RNA, 19 nt, Artificial Sequence
  siRNA Sense Sequence
uuccaggauacucgugacg

SEQ ID NO: 3182 - RNA, 19 nt, Artificial Sequence
  siRNA Antisense Sequence
cgucacgaguauccuggaa

SEQ ID NO: 3183 - RNA, 19 nt, Artificial Sequence
  siRNA Sense Sequence
uccaggauacucgugacgc

SEQ ID NO: 3184 - RNA, 19 nt, Artificial Sequence
  siRNA Antisense Sequence
gcgucacgaguauccugga

SEQ ID NO: 3185 - RNA, 19 nt, Artificial Sequence
  siRNA Sense Sequence
ccaggauacucgugacgcg

SEQ ID NO: 3186 - RNA, 19 nt, Artificial Sequence
  siRNA Antisense Sequence
cgcgucacgaguauccugg

SEQ ID NO: 3187 - RNA, 19 nt, Artificial Sequence
  siRNA Sense Sequence
caggauacucgugacgcgu

SEQ ID NO: 3188 - RNA, 19 nt, Artificial Sequence
  siRNA Antisense Sequence
acgcgucacgaguauccug

SEQ ID NO: 3189 - RNA, 19 nt, Artificial Sequence
  siRNA Sense Sequence
aggauacucgugacgcguc

SEQ ID NO: 3190 - RNA, 19 nt, Artificial Sequence
  siRNA Antisense Sequence
gacgcgucacgaguauccu

SEQ ID NO: 3191 - RNA, 19 nt, Artificial Sequence
  siRNA Sense Sequence
ggauacucgugacgcgucc

SEQ ID NO: 3192 - RNA, 19 nt, Artificial Sequence
  siRNA Antisense Sequence
ggacgcgucacgaguaucc

SEQ ID NO: 3193 - RNA, 19 nt, Artificial Sequence
  siRNA Sense Sequence
ccauuucccacucccauug

SEQ ID NO: 3194 - RNA, 19 nt, Artificial Sequence
  siRNA Antisense Sequence
caaugggagugggaaaugg

SEQ ID NO: 3195 - RNA, 19 nt, Artificial Sequence
  siRNA Sense Sequence
cauuucccacucccauugg

SEQ ID NO: 3196 - RNA, 19 nt, Artificial Sequence
  siRNA Antisense Sequence
ccaaugggagugggaaaug

SEQ ID NO: 3197 - RNA, 19 nt, Artificial Sequence
  siRNA Sense Sequence
ccacucccauugggugucg

SEQ ID NO: 3198 - RNA, 19 nt, Artificial Sequence
  siRNA Antisense Sequence
cgacacccaaugggagugg

SEQ ID NO: 3199 - RNA, 19 nt, Artificial Sequence
  siRNA Sense Sequence
ucccauugggugucgggug

SEQ ID NO: 3200 - RNA, 19 nt, Artificial Sequence
  siRNA Antisense Sequence
cacccgacacccaauggga

SEQ ID NO: 3201 - RNA, 19 nt, Artificial Sequence
  siRNA Sense Sequence
cccauugggugucgggugu

SEQ ID NO: 3202 - RNA, 19 nt, Artificial Sequence
  siRNA Antisense Sequence
acacccgacacccaauggg

SEQ ID NO: 3203 - RNA, 19 nt, Artificial Sequence
  siRNA Sense Sequence
ccauugggugucggguguc

SEQ ID NO: 3204 - RNA, 19 nt, Artificial Sequence
  siRNA Antisense Sequence
gacacccgacacccaaugg

SEQ ID NO: 3205 - RNA, 19 nt, Artificial Sequence
  siRNA Sense Sequence
cauugggugucgggugucu

SEQ ID NO: 3206 - RNA, 19 nt, Artificial Sequence
  siRNA Antisense Sequence
agacacccgacacccaaug

SEQ ID NO: 3207 - RNA, 19 nt, Artificial Sequence
  siRNA Sense Sequence
auugggugucgggugucua

SEQ ID NO: 3208 - RNA, 19 nt, Artificial Sequence
  siRNA Antisense Sequence
uagacacccgacacccaau

SEQ ID NO: 3209 - RNA, 19 nt, Artificial Sequence
  siRNA Sense Sequence
uugggugucgggugucuag

SEQ ID NO: 3210 - RNA, 19 nt, Artificial Sequence
  siRNA Antisense Sequence
cuagacacccgacacccaa

SEQ ID NO: 3211 - RNA, 19 nt, Artificial Sequence
  siRNA Sense Sequence
ugggugucgggugucuaga

SEQ ID NO: 3212 - RNA, 19 nt, Artificial Sequence
  siRNA Antisense Sequence
ucuagacacccgacaccca

SEQ ID NO: 3213 - RNA, 19 nt, Artificial Sequence
  siRNA Sense Sequence
gggugucgggugucuagag

SEQ ID NO: 3214 - RNA, 19 nt, Artificial Sequence
  siRNA Antisense Sequence
cucuagacacccgacaccc

SEQ ID NO: 3215 - RNA, 19 nt, Artificial Sequence
  siRNA Sense Sequence
agaagccaaucagugucgc

SEQ ID NO: 3216 - RNA, 19 nt, Artificial Sequence
  siRNA Antisense Sequence
gcgacacugauuggcuucu

SEQ ID NO: 3217 - RNA, 19 nt, Artificial Sequence
  siRNA Sense Sequence
gaagccaaucagugucgcc

SEQ ID NO: 3218 - RNA, 19 nt, Artificial Sequence
  siRNA Antisense Sequence
ggcgacacugauuggcuuc

SEQ ID NO: 3219 - RNA, 19 nt, Artificial Sequence
  siRNA Sense Sequence
aagccaaucagugucgccg

SEQ ID NO: 3220 - RNA, 19 nt, Artificial Sequence
  siRNA Antisense Sequence
cggcgacacugauuggcuu

SEQ ID NO: 3221 - RNA, 19 nt, Artificial Sequence
  siRNA Sense Sequence
gggucccaguucuaaaguc

SEQ ID NO: 3222 - RNA, 19 nt, Artificial Sequence
  siRNA Antisense Sequence
gacuuuagaacugggaccc

SEQ ID NO: 3223 - RNA, 19 nt, Artificial Sequence
  siRNA Sense Sequence
ggucccaguucuaaagucc

SEQ ID NO: 3224 - RNA, 19 nt, Artificial Sequence
  siRNA Antisense Sequence
ggacuuuagaacugggacc

SEQ ID NO: 3225 - RNA, 19 nt, Artificial Sequence
  siRNA Sense Sequence
gucccaguucuaaaguccc

SEQ ID NO: 3226 - RNA, 19 nt, Artificial Sequence
  siRNA Antisense Sequence
gggacuuuagaacugggac

SEQ ID NO: 3227 - RNA, 19 nt, Artificial Sequence
  siRNA Sense Sequence
acccacccggacucagaau

SEQ ID NO: 3228 - RNA, 19 nt, Artificial Sequence
  siRNA Antisense Sequence
auucugaguccgggugggu

SEQ ID NO: 3229 - RNA, 19 nt, Artificial Sequence
  siRNA Sense Sequence
cccacccggacucagaauc

SEQ ID NO: 3230 - RNA, 19 nt, Artificial Sequence
  siRNA Antisense Sequence
gauucugaguccggguggg

SEQ ID NO: 3231 - RNA, 19 nt, Artificial Sequence
  siRNA Sense Sequence
ccacccggacucagaaucu

SEQ ID NO: 3232 - RNA, 19 nt, Artificial Sequence
  siRNA Antisense Sequence
agauucugaguccgggugg

SEQ ID NO: 3233 - RNA, 19 nt, Artificial Sequence
  siRNA Sense Sequence
cacccggacucagaaucuc

SEQ ID NO: 3234 - RNA, 19 nt, Artificial Sequence
  siRNA Antisense Sequence
gagauucugaguccgggug

SEQ ID NO: 3235 - RNA, 19 nt, Artificial Sequence
  siRNA Sense Sequence
acccggacucagaaucucc

SEQ ID NO: 3236 - RNA, 19 nt, Artificial Sequence
  siRNA Antisense Sequence
ggagauucugaguccgggu

SEQ ID NO: 3237 - RNA, 19 nt, Artificial Sequence
  siRNA Sense Sequence
cccggacucagaaucuccu

SEQ ID NO: 3238 - RNA, 19 nt, Artificial Sequence
  siRNA Antisense Sequence
aggagauucugaguccggg

SEQ ID NO: 3239 - RNA, 19 nt, Artificial Sequence
  siRNA Sense Sequence
ccggacucagaaucuccuc

SEQ ID NO: 3240 - RNA, 19 nt, Artificial Sequence
  siRNA Antisense Sequence
gaggagauucugaguccgg

SEQ ID NO: 3241 - RNA, 19 nt, Artificial Sequence
  siRNA Sense Sequence
acucagaaucuccucagac

SEQ ID NO: 3242 - RNA, 19 nt, Artificial Sequence
  siRNA Antisense Sequence
gucugaggagauucugagu

SEQ ID NO: 3243 - RNA, 19 nt, Artificial Sequence
  siRNA Sense Sequence
cucagaaucuccucagacg

SEQ ID NO: 3244 - RNA, 19 nt, Artificial Sequence
  siRNA Antisense Sequence
cgucugaggagauucugag

SEQ ID NO: 3245 - RNA, 19 nt, Artificial Sequence
  siRNA Sense Sequence
ucagaaucuccucagacgc

SEQ ID NO: 3246 - RNA, 19 nt, Artificial Sequence
  siRNA Antisense Sequence
gcgucugaggagauucuga

SEQ ID NO: 3247 - RNA, 19 nt, Artificial Sequence
  siRNA Sense Sequence
cagaaucuccucagacgcc

SEQ ID NO: 3248 - RNA, 19 nt, Artificial Sequence
  siRNA Antisense Sequence
ggcgucugaggagauucug

SEQ ID NO: 3249 - RNA, 19 nt, Artificial Sequence
  siRNA Sense Sequence
agaaucuccucagacgccg

SEQ ID NO: 3250 - RNA, 19 nt, Artificial Sequence
  siRNA Antisense Sequence
cggcgucugaggagauucu

SEQ ID NO: 3251 - RNA, 19 nt, Artificial Sequence
  siRNA Sense Sequence
gaaucuccucagacgccga

SEQ ID NO: 3252 - RNA, 19 nt, Artificial Sequence
  siRNA Antisense Sequence
ucggcgucugaggagauuc

SEQ ID NO: 3253 - RNA, 19 nt, Artificial Sequence
  siRNA Sense Sequence
aaucuccucagacgccgag

SEQ ID NO: 3254 - RNA, 19 nt, Artificial Sequence
  siRNA Antisense Sequence
cucggcgucugaggagauu

SEQ ID NO: 3255 - RNA, 19 nt, Artificial Sequence
  siRNA Sense Sequence
uggcucccacuccaugagg

SEQ ID NO: 3256 - RNA, 19 nt, Artificial Sequence
  siRNA Antisense Sequence
ccucauggagugggagcca

SEQ ID NO: 3257 - RNA, 19 nt, Artificial Sequence
  siRNA Sense Sequence
cuccaugagguauuuccac

SEQ ID NO: 3258 - RNA, 19 nt, Artificial Sequence
  siRNA Antisense Sequence
guggaaauaccucauggag

SEQ ID NO: 3259 - RNA, 19 nt, Artificial Sequence
  siRNA Sense Sequence
uccaugagguauuuccaca

SEQ ID NO: 3260 - RNA, 19 nt, Artificial Sequence
  siRNA Antisense Sequence
uguggaaauaccucaugga

SEQ ID NO: 3261 - RNA, 19 nt, Artificial Sequence
  siRNA Sense Sequence
ccaugagguauuuccacac

SEQ ID NO: 3262 - RNA, 19 nt, Artificial Sequence
  siRNA Antisense Sequence
guguggaaauaccucaugg

SEQ ID NO: 3263 - RNA, 19 nt, Artificial Sequence
  siRNA Sense Sequence
gguauuuccacaccuccgu

SEQ ID NO: 3264 - RNA, 19 nt, Artificial Sequence
  siRNA Antisense Sequence
acggagguguggaaauacc

SEQ ID NO: 3265 - RNA, 19 nt, Artificial Sequence
  siRNA Sense Sequence
guauuuccacaccuccgug

SEQ ID NO: 3266 - RNA, 19 nt, Artificial Sequence
  siRNA Antisense Sequence
cacggagguguggaaauac

SEQ ID NO: 3267 - RNA, 19 nt, Artificial Sequence
  siRNA Sense Sequence
cgcuucaucaccgugggcu

SEQ ID NO: 3268 - RNA, 19 nt, Artificial Sequence
  siRNA Antisense Sequence
agcccacggugaugaagcg

SEQ ID NO: 3269 - RNA, 19 nt, Artificial Sequence
  siRNA Sense Sequence
gcuucaucaccgugggcua

SEQ ID NO: 3270 - RNA, 19 nt, Artificial Sequence
  siRNA Antisense Sequence
uagcccacggugaugaagc

SEQ ID NO: 3271 - RNA, 19 nt, Artificial Sequence
  siRNA Sense Sequence
cuucaucaccgugggcuac

SEQ ID NO: 3272 - RNA, 19 nt, Artificial Sequence
  siRNA Antisense Sequence
guagcccacggugaugaag

SEQ ID NO: 3273 - RNA, 19 nt, Artificial Sequence
  siRNA Sense Sequence
uucaucaccgugggcuacg

SEQ ID NO: 3274 - RNA, 19 nt, Artificial Sequence
  siRNA Antisense Sequence
cguagcccacggugaugaa

SEQ ID NO: 3275 - RNA, 19 nt, Artificial Sequence
  siRNA Antisense Sequence
ucaccgugggcuacgugga

SEQ ID NO: 3276 - RNA, 19 nt, Artificial Sequence
  siRNA Antisense Sequence
uccacguagcccacgguga

SEQ ID NO: 3277 - RNA, 19 nt, Artificial Sequence
  siRNA Sense Sequence
guggacgacacgcuguucg

SEQ ID NO: 3278 - RNA, 19 nt, Artificial Sequence
  siRNA Antisense Sequence
cgaacagcgugucguccac

SEQ ID NO: 3279 - RNA, 19 nt, Artificial Sequence
  siRNA Sense Sequence
acgcuguucgugagguucg

SEQ ID NO: 3280 - RNA, 19 nt, Artificial Sequence
  siRNA Antisense Sequence
cgaaccucacgaacagcgu

SEQ ID NO: 3281 - RNA, 19 nt, Artificial Sequence
  siRNA Sense Sequence
cgcuguucgugagguucga

SEQ ID NO: 3282 - RNA, 19 nt, Artificial Sequence
  siRNA Antisense Sequence
ucgaaccucacgaacagcg

SEQ ID NO: 3283 - RNA, 19 nt, Artificial Sequence
  siRNA Sense Sequence
gcuguucgugagguucgac

SEQ ID NO: 3284 - RNA, 19 nt, Artificial Sequence
  siRNA Antisense Sequence
gucgaaccucacgaacagc

SEQ ID NO: 3285 - RNA, 19 nt, Artificial Sequence
  siRNA Sense Sequence
cuguucgugagguucgaca

SEQ ID NO: 3286 - RNA, 19 nt, Artificial Sequence
  siRNA Antisense Sequence
ugucgaaccucacgaacag

SEQ ID NO: 3287 - RNA, 19 nt, Artificial Sequence
  siRNA Sense Sequence
uguucgugagguucgacag

SEQ ID NO: 3288 - RNA, 19 nt, Artificial Sequence
  siRNA Antisense Sequence
cugucgaaccucacgaaca

SEQ ID NO: 3289 - RNA, 19 nt, Artificial Sequence
  siRNA Sense Sequence
guucgugagguucgacagc

SEQ ID NO: 3290 - RNA, 19 nt, Artificial Sequence
  siRNA Antisense Sequence
gcugucgaaccucacgaac

SEQ ID NO: 3291 - RNA, 19 nt, Artificial Sequence
  siRNA Sense Sequence
uucgugagguucgacagcg

SEQ ID NO: 3292 - RNA, 19 nt, Artificial Sequence
  siRNA Antisense Sequence
cgcugucgaaccucacgaa

SEQ ID NO: 3293 - RNA, 19 nt, Artificial Sequence
  siRNA Sense Sequence
ucgugagguucgacagcga

SEQ ID NO: 3294 - RNA, 19 nt, Artificial Sequence
  siRNA Antisense Sequence
ucgcugucgaaccucacga

SEQ ID NO: 3295 - RNA, 19 nt, Artificial Sequence
  siRNA Sense Sequence
cgugagguucgacagcgac

SEQ ID NO: 3296 - RNA, 19 nt, Artificial Sequence
  siRNA Antisense Sequence
gucgcugucgaaccucacg

SEQ ID NO: 3297 - RNA, 19 nt, Artificial Sequence
  siRNA Sense Sequence
gugagguucgacagcgacg

SEQ ID NO: 3298 - RNA, 19 nt, Artificial Sequence
  siRNA Antisense Sequence
cgucgcugucgaaccucac

SEQ ID NO: 3299 - RNA, 19 nt, Artificial Sequence
  siRNA Sense Sequence
cguggauagagcaggaggg

SEQ ID NO: 3300 - RNA, 19 nt, Artificial Sequence
  siRNA Antisense Sequence
cccuccugcucuauccacg

SEQ ID NO: 3301 - RNA, 19 nt, Artificial Sequence
  siRNA Sense Sequence
cggaguauugggaccggga

SEQ ID NO: 3302 - RNA, 19 nt, Artificial Sequence
  siRNA Antisense Sequence
ucccggucccaauacuccg

SEQ ID NO: 3303 - RNA, 19 nt, Artificial Sequence
  siRNA Sense Sequence
ggaguauugggaccgggag

SEQ ID NO: 3304 - RNA, 19 nt, Artificial Sequence
  siRNA Antisense Sequence
cucccggucccaauacucc

SEQ ID NO: 3305 - RNA, 19 nt, Artificial Sequence
  siRNA Sense Sequence
acagaucugcaaggccaag

SEQ ID NO: 3306 - RNA, 19 nt, Artificial Sequence
  siRNA Antisense Sequence
cuuggccuugcagaucugu

SEQ ID NO: 3307 - RNA, 19 nt, Artificial Sequence
  siRNA Sense Sequence
aucugcaaggccaaggcac

SEQ ID NO: 3308 - RNA, 19 nt, Artificial Sequence
  siRNA Antisense Sequence
gugccuuggccuugcagau

SEQ ID NO: 3309 - RNA, 19 nt, Artificial Sequence
  siRNA Sense Sequence
ucugcaaggccaaggcaca

SEQ ID NO: 3310 - RNA, 19 nt, Artificial Sequence
  siRNA Antisense Sequence
ugugccuuggccuugcaga

SEQ ID NO: 3311 - RNA, 19 nt, Artificial Sequence
  siRNA Sense Sequence
cugcaaggccaaggcacag

SEQ ID NO: 3312 - RNA, 19 nt, Artificial Sequence
  siRNA Antisense Sequence
cugugccuuggccuugcag

SEQ ID NO: 3313 - RNA, 19 nt, Artificial Sequence
  siRNA Sense Sequence
ugcaaggccaaggcacaga

SEQ ID NO: 3314 - RNA, 19 nt, Artificial Sequence
  siRNA Antisense Sequence
ucugugccuuggccuugca

SEQ ID NO: 3315 - RNA, 19 nt, Artificial Sequence
  siRNA Sense Sequence
gcaaggccaaggcacagac

SEQ ID NO: 3316 - RNA, 19 nt, Artificial Sequence
  siRNA Antisense Sequence
gucugugccuuggccuugc

SEQ ID NO: 3317 - RNA, 19 nt, Artificial Sequence
  siRNA Sense Sequence
caaggccaaggcacagacu

SEQ ID NO: 3318 - RNA, 19 nt, Artificial Sequence
  siRNA Antisense Sequence
agucugugccuuggccuug

SEQ ID NO: 3319 - RNA, 19 nt, Artificial Sequence
  siRNA Sense Sequence
aaggcacagacugaccgag

SEQ ID NO: 3320 - RNA, 19 nt, Artificial Sequence
  siRNA Antisense Sequence
cucggucagucugugccuu

SEQ ID NO: 3321 - RNA, 19 nt, Artificial Sequence
  siRNA Sense Sequence
ggacccugcuccgcuacua

SEQ ID NO: 3322 - RNA, 19 nt, Artificial Sequence
  siRNA Antisense Sequence
uaguagcggagcagggucc

SEQ ID NO: 3323 - RNA, 19 nt, Artificial Sequence
  siRNA Sense Sequence
gacccugcuccgcuacuac

SEQ ID NO: 3324 - RNA, 19 nt, Artificial Sequence
  siRNA Antisense Sequence
guaguagcggagcaggguc

SEQ ID NO: 3325 - RNA, 19 nt, Artificial Sequence
  siRNA Sense Sequence
acccugcuccgcuacuaca

SEQ ID NO: 3326 - RNA, 19 nt, Artificial Sequence
  siRNA Antisense Sequence
uguaguagcggagcagggu

SEQ ID NO: 3327 - RNA, 19 nt, Artificial Sequence
  siRNA Sense Sequence
ggucucacacccuccagaa

SEQ ID NO: 3328 - RNA, 19 nt, Artificial Sequence
  siRNA Antisense Sequence
uucuggagggugugagacc

SEQ ID NO: 3329 - RNA, 19 nt, Artificial Sequence
  siRNA Sense Sequence
gucucacacccuccagaau

SEQ ID NO: 3330 - RNA, 19 nt, Artificial Sequence
  siRNA Antisense Sequence
auucuggagggugugagac

SEQ ID NO: 3331 - RNA, 19 nt, Artificial Sequence
  siRNA Sense Sequence
ucucacacccuccagaaua

SEQ ID NO: 3332 - RNA, 19 nt, Artificial Sequence
  siRNA Antisense Sequence
uauucuggagggugugaga

SEQ ID NO: 3333 - RNA, 19 nt, Artificial Sequence
  siRNA Sense Sequence
cucacacccuccagaauau

SEQ ID NO: 3334 - RNA, 19 nt, Artificial Sequence
  siRNA Antisense Sequence
auauucuggagggugugag

SEQ ID NO: 3335 - RNA, 19 nt, Artificial Sequence
  siRNA Sense Sequence
ucacacccuccagaauaug

SEQ ID NO: 3336 - RNA, 19 nt, Artificial Sequence
  siRNA Antisense Sequence
cauauucuggaggguguga

SEQ ID NO: 3337 - RNA, 19 nt, Artificial Sequence
  siRNA Sense Sequence
cacacccuccagaauaugu

SEQ ID NO: 3338 - RNA, 19 nt, Artificial Sequence
  siRNA Antisense Sequence
acauauucuggagggugug

SEQ ID NO: 3339 - RNA, 19 nt, Artificial Sequence
  siRNA Sense Sequence
acacccuccagaauaugua

SEQ ID NO: 3340 - RNA, 19 nt, Artificial Sequence
  siRNA Antisense Sequence
uacauauucuggagggugu

SEQ ID NO: 3341 - RNA, 19 nt, Artificial Sequence
  siRNA Sense Sequence
cacccuccagaauauguau

SEQ ID NO: 3342 - RNA, 19 nt, Artificial Sequence
  siRNA Antisense Sequence
auacauauucuggagggug

SEQ ID NO: 3343 - RNA, 19 nt, Artificial Sequence
  siRNA Sense Sequence
acccuccagaauauguaug

SEQ ID NO: 3344 - RNA, 19 nt, Artificial Sequence
  siRNA Antisense Sequence
cauacauauucuggagggu

SEQ ID NO: 3345 - RNA, 19 nt, Artificial Sequence
  siRNA Sense Sequence
cccuccagaauauguaugg

SEQ ID NO: 3346 - RNA, 19 nt, Artificial Sequence
  siRNA Antisense Sequence
ccauacauauucuggaggg

SEQ ID NO: 3347 - RNA, 19 nt, Artificial Sequence
  siRNA Sense Sequence
ccuccagaauauguauggc

SEQ ID NO: 3348 - RNA, 19 nt, Artificial Sequence
  siRNA Antisense Sequence
gccauacauauucuggagg

SEQ ID NO: 3349 - RNA, 19 nt, Artificial Sequence
  siRNA Sense Sequence
cuccagaauauguauggcu

SEQ ID NO: 3350 - RNA, 19 nt, Artificial Sequence
  siRNA Antisense Sequence
agccauacauauucuggag

SEQ ID NO: 3351 - RNA, 19 nt, Artificial Sequence
  siRNA Sense Sequence
uccagaauauguauggcug

SEQ ID NO: 3352 - RNA, 19 nt, Artificial Sequence
  siRNA Antisense Sequence
cagccauacauauucugga

SEQ ID NO: 3353 - RNA, 19 nt, Artificial Sequence
  siRNA Sense Sequence
ccagaauauguauggcugc

SEQ ID NO: 3354 - RNA, 19 nt, Artificial Sequence
  siRNA Antisense Sequence
gcagccauacauauucugg

SEQ ID NO: 3355 - RNA, 19 nt, Artificial Sequence
  siRNA Sense Sequence
cagaauauguauggcugcg

SEQ ID NO: 3356 - RNA, 19 nt, Artificial Sequence
  siRNA Antisense Sequence
cgcagccauacauauucug

SEQ ID NO: 3357 - RNA, 19 nt, Artificial Sequence
  siRNA Sense Sequence
agaauauguauggcugcga

SEQ ID NO: 3358 - RNA, 19 nt, Artificial Sequence
  siRNA Antisense Sequence
ucgcagccauacauauucu

SEQ ID NO: 3359 - RNA, 19 nt, Artificial Sequence
  siRNA Sense Sequence
gaauauguauggcugcgac

SEQ ID NO: 3360 - RNA, 19 nt, Artificial Sequence
  siRNA Antisense Sequence
gucgcagccauacauauuc

SEQ ID NO: 3361 - RNA, 19 nt, Artificial Sequence
  siRNA Sense Sequence
aauauguauggcugcgacg

SEQ ID NO: 3362 - RNA, 19 nt, Artificial Sequence
  siRNA Antisense Sequence
cgucgcagccauacauauu

SEQ ID NO: 3363 - RNA, 19 nt, Artificial Sequence
  siRNA Sense Sequence
auauguauggcugcgacgu

SEQ ID NO: 3364 - RNA, 19 nt, Artificial Sequence
  siRNA Antisense Sequence
acgucgcagccauacauau

SEQ ID NO: 3365 - RNA, 19 nt, Artificial Sequence
  siRNA Sense Sequence
uauguauggcugcgacgug

SEQ ID NO: 3366 - RNA, 19 nt, Artificial Sequence
  siRNA Antisense Sequence
cacgucgcagccauacaua

SEQ ID NO: 3367 - RNA, 19 nt, Artificial Sequence
  siRNA Sense Sequence
auguauggcugcgacgugg

SEQ ID NO: 3368 - RNA, 19 nt, Artificial Sequence
  siRNA Antisense Sequence
ccacgucgcagccauacau

SEQ ID NO: 3369 - RNA, 19 nt, Artificial Sequence
  siRNA Sense Sequence
gguaccaccaggacgccua

SEQ ID NO: 3370 - RNA, 19 nt, Artificial Sequence
  siRNA Antisense Sequence
uaggcguccuggugguacc

SEQ ID NO: 3371 - RNA, 19 nt, Artificial Sequence
  siRNA Sense Sequence
guaccaccaggacgccuac

SEQ ID NO: 3372 - RNA, 19 nt, Artificial Sequence
  siRNA Antisense Sequence
guaggcguccuggugguac

SEQ ID NO: 3373 - RNA, 19 nt, Artificial Sequence
  siRNA Sense Sequence
uaccaccaggacgccuacg

SEQ ID NO: 3374 - RNA, 19 nt, Artificial Sequence
  siRNA Antisense Sequence
cguaggcguccugguggua

SEQ ID NO: 3375 - RNA, 19 nt, Artificial Sequence
  siRNA Antisense Sequence
accaccaggacgccuacga

SEQ ID NO: 3376 - RNA, 19 nt, Artificial Sequence
  siRNA Antisense Sequence
ucguaggcguccugguggu

SEQ ID NO: 3377 - RNA, 19 nt, Artificial Sequence
  siRNA Sense Sequence
aggacgccuacgacggcaa

SEQ ID NO: 3378 - RNA, 19 nt, Artificial Sequence
  siRNA Antisense Sequence
uugccgucguaggcguccu

SEQ ID NO: 3379 - RNA, 19 nt, Artificial Sequence
  siRNA Sense Sequence
cucagaucacccagcgcaa

SEQ ID NO: 3380 - RNA, 19 nt, Artificial Sequence
  siRNA Antisense Sequence
uugcgcugggugaucugag

SEQ ID NO: 3381 - RNA, 19 nt, Artificial Sequence
  siRNA Sense Sequence
ucagaucacccagcgcaag

SEQ ID NO: 3382 - RNA, 19 nt, Artificial Sequence
  siRNA Antisense Sequence
cuugcgcugggugaucuga

SEQ ID NO: 3383 - RNA, 19 nt, Artificial Sequence
  siRNA Sense Sequence
agaucacccagcgcaagug

SEQ ID NO: 3384 - RNA, 19 nt, Artificial Sequence
  siRNA Antisense Sequence
cacuugcgcugggugaucu

SEQ ID NO: 3385 - RNA, 19 nt, Artificial Sequence
  siRNA Sense Sequence
gaucacccagcgcaagugg

SEQ ID NO: 3386 - RNA, 19 nt, Artificial Sequence
  siRNA Antisense Sequence
ccacuugcgcugggugauc

SEQ ID NO: 3387 - RNA, 19 nt, Artificial Sequence
  siRNA Sense Sequence
caggacacugagcuugugg

SEQ ID NO: 3388 - RNA, 19 nt, Artificial Sequence
  siRNA Antisense Sequence
ccacaagcucaguguccug

SEQ ID NO: 3389 - RNA, 19 nt, Artificial Sequence
  siRNA Sense Sequence
ggacacugagcuuguggag

SEQ ID NO: 3390 - RNA, 19 nt, Artificial Sequence
  siRNA Antisense Sequence
cuccacaagcucagugucc

SEQ ID NO: 3391 - RNA, 19 nt, Artificial Sequence
  siRNA Sense Sequence
gagccgucuucccagucca

SEQ ID NO: 3392 - RNA, 19 nt, Artificial Sequence
  siRNA Antisense Sequence
uggacugggaagacggcuc

SEQ ID NO: 3393 - RNA, 19 nt, Artificial Sequence
  siRNA Sense Sequence
ugggcauuguugcuggccu

SEQ ID NO: 3394 - RNA, 19 nt, Artificial Sequence
  siRNA Antisense Sequence
aggccagcaacaaugccca

SEQ ID NO: 3395 - RNA, 19 nt, Artificial Sequence
  siRNA Sense Sequence
ggcauuguugcuggccugg

SEQ ID NO: 3396 - RNA, 19 nt, Artificial Sequence
  siRNA Antisense Sequence
ccaggccagcaacaaugcc

SEQ ID NO: 3397 - RNA, 19 nt, Artificial Sequence
  siRNA Sense Sequence
gcauuguugcuggccuggc

SEQ ID NO: 3398 - RNA, 19 nt, Artificial Sequence
  siRNA Antisense Sequence
gccaggccagcaacaaugc

SEQ ID NO: 3399 - RNA, 19 nt, Artificial Sequence
  siRNA Sense Sequence
cauuguugcuggccuggcu

SEQ ID NO: 3400 - RNA, 19 nt, Artificial Sequence
  siRNA Antisense Sequence
agccaggccagcaacaaug

SEQ ID NO: 3401 - RNA, 19 nt, Artificial Sequence
  siRNA Sense Sequence
auuguugcuggccuggcug

SEQ ID NO: 3402 - RNA, 19 nt, Artificial Sequence
  siRNA Antisense Sequence
cagccaggccagcaacaau

SEQ ID NO: 3403 - RNA, 19 nt, Artificial Sequence
  siRNA Sense Sequence
ugcuggccuggcuguccua

SEQ ID NO: 3404 - RNA, 19 nt, Artificial Sequence
  siRNA Antisense Sequence
uaggacagccaggccagca

SEQ ID NO: 3405 - RNA, 19 nt, Artificial Sequence
  siRNA Sense Sequence
uggccuggcuguccuagca

SEQ ID NO: 3406 - RNA, 19 nt, Artificial Sequence
  siRNA Antisense Sequence
ugcuaggacagccaggcca

SEQ ID NO: 3407 - RNA, 19 nt, Artificial Sequence
  siRNA Sense Sequence
gccuggcuguccuagcagu

SEQ ID NO: 3408 - RNA, 19 nt, Artificial Sequence
  siRNA Antisense Sequence
acugcuaggacagccaggc

SEQ ID NO: 3409 - RNA, 19 nt, Artificial Sequence
  siRNA Sense Sequence
ccuggcuguccuagcaguu

SEQ ID NO: 3410 - RNA, 19 nt, Artificial Sequence
  siRNA Antisense Sequence
aacugcuaggacagccagg

SEQ ID NO: 3411 - RNA, 19 nt, Artificial Sequence
  siRNA Sense Sequence
cuggcuguccuagcaguug

SEQ ID NO: 3412 - RNA, 19 nt, Artificial Sequence
  siRNA Antisense Sequence
caacugcuaggacagccag

SEQ ID NO: 3413 - RNA, 19 nt, Artificial Sequence
  siRNA Sense Sequence
uggcuguccuagcaguugu

SEQ ID NO: 3414 - RNA, 19 nt, Artificial Sequence
  siRNA Antisense Sequence
acaacugcuaggacagcca

SEQ ID NO: 3415 - RNA, 19 nt, Artificial Sequence
  siRNA Sense Sequence
ggcuguccuagcaguugug

SEQ ID NO: 3416 - RNA, 19 nt, Artificial Sequence
  siRNA Antisense Sequence
cacaacugcuaggacagcc

SEQ ID NO: 3417 - RNA, 19 nt, Artificial Sequence
  siRNA Sense Sequence
gcuguccuagcaguugugg

SEQ ID NO: 3418 - RNA, 19 nt, Artificial Sequence
  siRNA Antisense Sequence
ccacaacugcuaggacagc

SEQ ID NO: 3419 - RNA, 19 nt, Artificial Sequence
  siRNA Sense Sequence
uccuagcaguuguggucau

SEQ ID NO: 3420 - RNA, 19 nt, Artificial Sequence
  siRNA Antisense Sequence
augaccacaacugcuagga

SEQ ID NO: 3421 - RNA, 19 nt, Artificial Sequence
  siRNA Sense Sequence
ccuagcaguuguggucauc

SEQ ID NO: 3422 - RNA, 19 nt, Artificial Sequence
  siRNA Antisense Sequence
gaugaccacaacugcuagg

SEQ ID NO: 3423 - RNA, 19 nt, Artificial Sequence
  siRNA Sense Sequence
cuagcaguuguggucaucg

SEQ ID NO: 3424 - RNA, 19 nt, Artificial Sequence
  siRNA Antisense Sequence
cgaugaccacaacugcuag

SEQ ID NO: 3425 - RNA, 19 nt, Artificial Sequence
  siRNA Sense Sequence
uagcaguuguggucaucgg

SEQ ID NO: 3426 - RNA, 19 nt, Artificial Sequence
  siRNA Antisense Sequence
ccgaugaccacaacugcua

SEQ ID NO: 3427 - RNA, 19 nt, Artificial Sequence
  siRNA Sense Sequence
agcaguuguggucaucgga

SEQ ID NO: 3428 - RNA, 19 nt, Artificial Sequence
  siRNA Antisense Sequence
uccgaugaccacaacugcu

SEQ ID NO: 3429 - RNA, 19 nt, Artificial Sequence
  siRNA Sense Sequence
gcaguuguggucaucggag

SEQ ID NO: 3430 - RNA, 19 nt, Artificial Sequence
  siRNA Antisense Sequence
cuccgaugaccacaacugc

SEQ ID NO: 3431 - RNA, 19 nt, Artificial Sequence
  siRNA Sense Sequence
caguuguggucaucggagc

SEQ ID NO: 3432 - RNA, 19 nt, Artificial Sequence
  siRNA Antisense Sequence
gcuccgaugaccacaacug

SEQ ID NO: 3433 - RNA, 19 nt, Artificial Sequence
  siRNA Sense Sequence
aguuguggucaucggagcu

SEQ ID NO: 3434 - RNA, 19 nt, Artificial Sequence
  siRNA Antisense Sequence
agcuccgaugaccacaacu

SEQ ID NO: 3435 - RNA, 19 nt, Artificial Sequence
  siRNA Sense Sequence
guuguggucaucggagcug

SEQ ID NO: 3436 - RNA, 19 nt, Artificial Sequence
  siRNA Antisense Sequence
cagcuccgaugaccacaac

SEQ ID NO: 3437 - RNA, 19 nt, Artificial Sequence
  siRNA Sense Sequence
uuguggucaucggagcugu

SEQ ID NO: 3438 - RNA, 19 nt, Artificial Sequence
  siRNA Antisense Sequence
acagcuccgaugaccacaa

SEQ ID NO: 3439 - RNA, 19 nt, Artificial Sequence
  siRNA Sense Sequence
uguggucaucggagcugug

SEQ ID NO: 3440 - RNA, 19 nt, Artificial Sequence
  siRNA Antisense Sequence
cacagcuccgaugaccaca

SEQ ID NO: 3441 - RNA, 19 nt, Artificial Sequence
  siRNA Sense Sequence
guggucaucggagcugugg

SEQ ID NO: 3442 - RNA, 19 nt, Artificial Sequence
  siRNA Antisense Sequence
ccacagcuccgaugaccac

SEQ ID NO: 3443 - RNA, 19 nt, Artificial Sequence
  siRNA Sense Sequence
ucaucggagcuguggucgc

SEQ ID NO: 3444 - RNA, 19 nt, Artificial Sequence
  siRNA Antisense Sequence
gcgaccacagcuccgauga

SEQ ID NO: 3445 - RNA, 19 nt, Artificial Sequence
  siRNA Sense Sequence
caucggagcuguggucgcu

SEQ ID NO: 3446 - RNA, 19 nt, Artificial Sequence
  siRNA Antisense Sequence
agcgaccacagcuccgaug

SEQ ID NO: 3447 - RNA, 19 nt, Artificial Sequence
  siRNA Sense Sequence
aucggagcuguggucgcug

SEQ ID NO: 3448 - RNA, 19 nt, Artificial Sequence
  siRNA Antisense Sequence
cagcgaccacagcuccgau

SEQ ID NO: 3449 - RNA, 19 nt, Artificial Sequence
  siRNA Sense Sequence
guggucgcugcugugaugu

SEQ ID NO: 3450 - RNA, 19 nt, Artificial Sequence
  siRNA Antisense Sequence
acaucacagcagcgaccac

SEQ ID NO: 3451 - RNA, 19 nt, Artificial Sequence
  siRNA Sense Sequence
cgcugcugugauguguagg

SEQ ID NO: 3452 - RNA, 19 nt, Artificial Sequence
  siRNA Antisense Sequence
ccuacacaucacagcagcg

SEQ ID NO: 3453 - RNA, 19 nt, Artificial Sequence
  siRNA Sense Sequence
gcugugauguguaggagga

SEQ ID NO: 3454 - RNA, 19 nt, Artificial Sequence
  siRNA Antisense Sequence
uccuccuacacaucacagc

SEQ ID NO: 3455 - RNA, 19 nt, Artificial Sequence
  siRNA Sense Sequence
ugauguguaggaggaagag

SEQ ID NO: 3456 - RNA, 19 nt, Artificial Sequence
  siRNA Antisense Sequence
cucuuccuccuacacauca

SEQ ID NO: 3457 - RNA, 19 nt, Artificial Sequence
  siRNA Sense Sequence
guguaggaggaagagcuca

SEQ ID NO: 3458 - RNA, 19 nt, Artificial Sequence
  siRNA Antisense Sequence
ugagcucuuccuccuacac

SEQ ID NO: 3459 - RNA, 19 nt, Artificial Sequence
  siRNA Sense Sequence
agcuacucucaggcugcgu

SEQ ID NO: 3460 - RNA, 19 nt, Artificial Sequence
  siRNA Antisense Sequence
acgcagccugagaguagcu

SEQ ID NO: 3461 - RNA, 19 nt, Artificial Sequence
  siRNA Sense Sequence
gcuacucucaggcugcgug

SEQ ID NO: 3462 - RNA, 19 nt, Artificial Sequence
  siRNA Antisense Sequence
cacgcagccugagaguagc

SEQ ID NO: 3463 - RNA, 19 nt, Artificial Sequence
  siRNA Sense Sequence
cuacucucaggcugcgugc

SEQ ID NO: 3464 - RNA, 19 nt, Artificial Sequence
  siRNA Antisense Sequence
gcacgcagccugagaguag

SEQ ID NO: 3465 - RNA, 19 nt, Artificial Sequence
  siRNA Sense Sequence
uacucucaggcugcgugca

SEQ ID NO: 3466 - RNA, 19 nt, Artificial Sequence
  siRNA Antisense Sequence
ugcacgcagccugagagua

SEQ ID NO: 3467 - RNA, 19 nt, Artificial Sequence
  siRNA Sense Sequence
gugucucucacagcuugaa

SEQ ID NO: 3468 - RNA, 19 nt, Artificial Sequence
  siRNA Antisense Sequence
uucaagcugugagagacac

SEQ ID NO: 3469 - RNA, 19 nt, Artificial Sequence
  siRNA Sense Sequence
agauucuuugauugggaug

SEQ ID NO: 3470 - RNA, 19 nt, Artificial Sequence
  siRNA Antisense Sequence
caucccaaucaaagaaucu

SEQ ID NO: 3471 - RNA, 19 nt, Artificial Sequence
  siRNA Sense Sequence
gauucuuugauugggaugu

SEQ ID NO: 3472 - RNA, 19 nt, Artificial Sequence
  siRNA Antisense Sequence
acaucccaaucaaagaauc

SEQ ID NO: 3473 - RNA, 19 nt, Artificial Sequence
  siRNA Sense Sequence
auucuuugauugggauguu

SEQ ID NO: 3474 - RNA, 19 nt, Artificial Sequence
  siRNA Antisense Sequence
aacaucccaaucaaagaau

SEQ ID NO: 3475 - RNA, 19 nt, Artificial Sequence
  siRNA Antisense Sequence
uucuuugauugggauguuu

SEQ ID NO: 3476 - RNA, 19 nt, Artificial Sequence
  siRNA Antisense Sequence
aaacaucccaaucaaagaa

SEQ ID NO: 3477 - RNA, 19 nt, Artificial Sequence
  siRNA Sense Sequence
uugauugggauguuucgcg

SEQ ID NO: 3478 - RNA, 19 nt, Artificial Sequence
  siRNA Antisense Sequence
cgcgaaacaucccaaucaa

SEQ ID NO: 3479 - RNA, 19 nt, Artificial Sequence
  siRNA Sense Sequence
ugauugggauguuucgcgu

SEQ ID NO: 3480 - RNA, 19 nt, Artificial Sequence
  siRNA Antisense Sequence
acgcgaaacaucccaauca

SEQ ID NO: 3481 - RNA, 19 nt, Artificial Sequence
  siRNA Sense Sequence
gauugggauguuucgcgug

SEQ ID NO: 3482 - RNA, 19 nt, Artificial Sequence
  siRNA Antisense Sequence
cacgcgaaacaucccaauc

SEQ ID NO: 3483 - RNA, 19 nt, Artificial Sequence
  siRNA Sense Sequence
auugggauguuucgcgugu

SEQ ID NO: 3484 - RNA, 19 nt, Artificial Sequence
  siRNA Antisense Sequence
acacgcgaaacaucccaau

SEQ ID NO: 3485 - RNA, 19 nt, Artificial Sequence
  siRNA Sense Sequence
uugggauguuucgcgugug

SEQ ID NO: 3486 - RNA, 19 nt, Artificial Sequence
  siRNA Antisense Sequence
cacacgcgaaacaucccaa

SEQ ID NO: 3487 - RNA, 19 nt, Artificial Sequence
  siRNA Sense Sequence
guuucgcgugugugguggg

SEQ ID NO: 3488 - RNA, 19 nt, Artificial Sequence
  siRNA Antisense Sequence
cccaccacacacgcgaaac

SEQ ID NO: 3489 - RNA, 19 nt, Artificial Sequence
  siRNA Sense Sequence
uuucgcguguguggugggc

SEQ ID NO: 3490 - RNA, 19 nt, Artificial Sequence
  siRNA Antisense Sequence
gcccaccacacacgcgaaa

SEQ ID NO: 3491 - RNA, 19 nt, Artificial Sequence
  siRNA Sense Sequence
uucgcguguguggugggcu

SEQ ID NO: 3492 - RNA, 19 nt, Artificial Sequence
  siRNA Antisense Sequence
agcccaccacacacgcgaa

SEQ ID NO: 3493 - RNA, 19 nt, Artificial Sequence
  siRNA Sense Sequence
gcguguguggugggcuguu

SEQ ID NO: 3494 - RNA, 19 nt, Artificial Sequence
  siRNA Antisense Sequence
aacagcccaccacacacgc

SEQ ID NO: 3495 - RNA, 19 nt, Artificial Sequence
  siRNA Sense Sequence
cguguguggugggcuguuu

SEQ ID NO: 3496 - RNA, 19 nt, Artificial Sequence
  siRNA Antisense Sequence
aaacagcccaccacacacg

SEQ ID NO: 3497 - RNA, 19 nt, Artificial Sequence
  siRNA Sense Sequence
guguguggugggcuguuua

SEQ ID NO: 3498 - RNA, 19 nt, Artificial Sequence
  siRNA Antisense Sequence
uaaacagcccaccacacac

SEQ ID NO: 3499 - RNA, 19 nt, Artificial Sequence
  siRNA Sense Sequence
uguguggugggcuguuuag

SEQ ID NO: 3500 - RNA, 19 nt, Artificial Sequence
  siRNA Antisense Sequence
cuaaacagcccaccacaca

SEQ ID NO: 3501 - RNA, 19 nt, Artificial Sequence
  siRNA Sense Sequence
guguggugggcuguuuaga

SEQ ID NO: 3502 - RNA, 19 nt, Artificial Sequence
  siRNA Antisense Sequence
ucuaaacagcccaccacac

SEQ ID NO: 3503 - RNA, 19 nt, Artificial Sequence
  siRNA Sense Sequence
uguggugggcuguuuagac

SEQ ID NO: 3504 - RNA, 19 nt, Artificial Sequence
  siRNA Antisense Sequence
gucuaaacagcccaccaca

SEQ ID NO: 3505 - RNA, 19 nt, Artificial Sequence
  siRNA Sense Sequence
guggugggcuguuuagacu

SEQ ID NO: 3506 - RNA, 19 nt, Artificial Sequence
  siRNA Antisense Sequence
agucuaaacagcccaccac

SEQ ID NO: 3507 - RNA, 19 nt, Artificial Sequence
  siRNA Sense Sequence
ugggcuguuuagacuguca

SEQ ID NO: 3508 - RNA, 19 nt, Artificial Sequence
  siRNA Antisense Sequence
ugacagucuaaacagccca

SEQ ID NO: 3509 - RNA, 19 nt, Artificial Sequence
  siRNA Sense Sequence
cuguuuagacugucaucac

SEQ ID NO: 3510 - RNA, 19 nt, Artificial Sequence
  siRNA Antisense Sequence
gugaugacagucuaaacag

SEQ ID NO: 3511 - RNA, 19 nt, Artificial Sequence
  siRNA Sense Sequence
uguuuagacugucaucacu

SEQ ID NO: 3512 - RNA, 19 nt, Artificial Sequence
  siRNA Antisense Sequence
agugaugacagucuaaaca

SEQ ID NO: 3513 - RNA, 19 nt, Artificial Sequence
  siRNA Sense Sequence
guuuagacugucaucacuu

SEQ ID NO: 3514 - RNA, 19 nt, Artificial Sequence
  siRNA Antisense Sequence
aagugaugacagucuaaac

SEQ ID NO: 3515 - RNA, 19 nt, Artificial Sequence
  siRNA Sense Sequence
uuuagacugucaucacuua

SEQ ID NO: 3516 - RNA, 19 nt, Artificial Sequence
  siRNA Antisense Sequence
uaagugaugacagucuaaa

SEQ ID NO: 3517 - RNA, 19 nt, Artificial Sequence
  siRNA Sense Sequence
uuagacugucaucacuuac

SEQ ID NO: 3518 - RNA, 19 nt, Artificial Sequence
  siRNA Antisense Sequence
guaagugaugacagucuaa

SEQ ID NO: 3519 - RNA, 19 nt, Artificial Sequence
  siRNA Sense Sequence
uagacugucaucacuuacc

SEQ ID NO: 3520 - RNA, 19 nt, Artificial Sequence
  siRNA Antisense Sequence
gguaagugaugacagucua

SEQ ID NO: 3521 - RNA, 19 nt, Artificial Sequence
  siRNA Sense Sequence
agacugucaucacuuacca

SEQ ID NO: 3522 - RNA, 19 nt, Artificial Sequence
  siRNA Antisense Sequence
ugguaagugaugacagucu

SEQ ID NO: 3523 - RNA, 19 nt, Artificial Sequence
  siRNA Sense Sequence
gacugucaucacuuaccau

SEQ ID NO: 3524 - RNA, 19 nt, Artificial Sequence
  siRNA Antisense Sequence
augguaagugaugacaguc

SEQ ID NO: 3525 - RNA, 19 nt, Artificial Sequence
  siRNA Sense Sequence
acugucaucacuuaccaug

SEQ ID NO: 3526 - RNA, 19 nt, Artificial Sequence
  siRNA Antisense Sequence
caugguaagugaugacagu

SEQ ID NO: 3527 - RNA, 19 nt, Artificial Sequence
  siRNA Sense Sequence
caucacuuaccaugacuaa

SEQ ID NO: 3528 - RNA, 19 nt, Artificial Sequence
  siRNA Antisense Sequence
uuagucaugguaagugaug

SEQ ID NO: 3529 - RNA, 19 nt, Artificial Sequence
  siRNA Sense Sequence
aucacuuaccaugacuaac

SEQ ID NO: 3530 - RNA, 19 nt, Artificial Sequence
  siRNA Antisense Sequence
guuagucaugguaagugau

SEQ ID NO: 3531 - RNA, 19 nt, Artificial Sequence
  siRNA Sense Sequence
ucacuuaccaugacuaacc

SEQ ID NO: 3532 - RNA, 19 nt, Artificial Sequence
  siRNA Antisense Sequence
gguuagucaugguaaguga

SEQ ID NO: 3533 - RNA, 19 nt, Artificial Sequence
  siRNA Sense Sequence
cacuuaccaugacuaacca

SEQ ID NO: 3534 - RNA, 19 nt, Artificial Sequence
  siRNA Antisense Sequence
ugguuagucaugguaagug

SEQ ID NO: 3535 - RNA, 19 nt, Artificial Sequence
  siRNA Sense Sequence
acuuaccaugacuaaccag

SEQ ID NO: 3536 - RNA, 19 nt, Artificial Sequence
  siRNA Antisense Sequence
cugguuagucaugguaagu

SEQ ID NO: 3537 - RNA, 19 nt, Artificial Sequence
  siRNA Sense Sequence
cuuaccaugacuaaccaga

SEQ ID NO: 3538 - RNA, 19 nt, Artificial Sequence
  siRNA Antisense Sequence
ucugguuagucaugguaag

SEQ ID NO: 3539 - RNA, 19 nt, Artificial Sequence
  siRNA Sense Sequence
uuaccaugacuaaccagaa

SEQ ID NO: 3540 - RNA, 19 nt, Artificial Sequence
  siRNA Antisense Sequence
uucugguuagucaugguaa

SEQ ID NO: 3541 - RNA, 19 nt, Artificial Sequence
  siRNA Sense Sequence
uaccaugacuaaccagaau

SEQ ID NO: 3542 - RNA, 19 nt, Artificial Sequence
  siRNA Antisense Sequence
auucugguuagucauggua

SEQ ID NO: 3543 - RNA, 19 nt, Artificial Sequence
  siRNA Sense Sequence
accaugacuaaccagaauu

SEQ ID NO: 3544 - RNA, 19 nt, Artificial Sequence
  siRNA Antisense Sequence
aauucugguuagucauggu

SEQ ID NO: 3545 - RNA, 19 nt, Artificial Sequence
  siRNA Sense Sequence
cuaaccagaauuuguucau

SEQ ID NO: 3546 - RNA, 19 nt, Artificial Sequence
  siRNA Antisense Sequence
augaacaaauucugguuag

SEQ ID NO: 3547 - RNA, 19 nt, Artificial Sequence
  siRNA Sense Sequence
uaaccagaauuuguucaug

SEQ ID NO: 3548 - RNA, 19 nt, Artificial Sequence
  siRNA Antisense Sequence
caugaacaaauucugguua

SEQ ID NO: 3549 - RNA, 19 nt, Artificial Sequence
  siRNA Sense Sequence
cagaauuuguucaugacug

SEQ ID NO: 3550 - RNA, 19 nt, Artificial Sequence
  siRNA Antisense Sequence
cagucaugaacaaauucug

SEQ ID NO: 3551 - RNA, 19 nt, Artificial Sequence
  siRNA Sense Sequence
agaauuuguucaugacugu

SEQ ID NO: 3552 - RNA, 19 nt, Artificial Sequence
  siRNA Antisense Sequence
acagucaugaacaaauucu

SEQ ID NO: 3553 - RNA, 19 nt, Artificial Sequence
  siRNA Sense Sequence
uuuguucaugacuguuguu

SEQ ID NO: 3554 - RNA, 19 nt, Artificial Sequence
  siRNA Antisense Sequence
aacaacagucaugaacaaa

SEQ ID NO: 3555 - RNA, 19 nt, Artificial Sequence
  siRNA Sense Sequence
uuguucaugacuguuguuu

SEQ ID NO: 3556 - RNA, 19 nt, Artificial Sequence
  siRNA Antisense Sequence
aaacaacagucaugaacaa

SEQ ID NO: 3557 - RNA, 19 nt, Artificial Sequence
  siRNA Sense Sequence
uguucaugacuguuguuuu

SEQ ID NO: 3558 - RNA, 19 nt, Artificial Sequence
  siRNA Antisense Sequence
aaaacaacagucaugaaca

SEQ ID NO: 3559 - RNA, 19 nt, Artificial Sequence
  siRNA Sense Sequence
guucaugacuguuguuuuc

SEQ ID NO: 3560 - RNA, 19 nt, Artificial Sequence
  siRNA Antisense Sequence
gaaaacaacagucaugaac

SEQ ID NO: 3561 - RNA, 19 nt, Artificial Sequence
  siRNA Sense Sequence
ucaugacuguuguuuucug

SEQ ID NO: 3562 - RNA, 19 nt, Artificial Sequence
  siRNA Antisense Sequence
cagaaaacaacagucauga

SEQ ID NO: 3563 - RNA, 19 nt, Artificial Sequence
  siRNA Sense Sequence
caugacuguuguuuucugu

SEQ ID NO: 3564 - RNA, 19 nt, Artificial Sequence
  siRNA Antisense Sequence
acagaaaacaacagucaug

SEQ ID NO: 3565 - RNA, 19 nt, Artificial Sequence
  siRNA Sense Sequence
augacuguuguuuucugua

SEQ ID NO: 3566 - RNA, 19 nt, Artificial Sequence
  siRNA Antisense Sequence
uacagaaaacaacagucau

SEQ ID NO: 3567 - RNA, 19 nt, Artificial Sequence
  siRNA Sense Sequence
acagcugucuugugaggga

SEQ ID NO: 3568 - RNA, 19 nt, Artificial Sequence
  siRNA Antisense Sequence
ucccucacaagacagcugu

SEQ ID NO: 3569 - RNA, 19 nt, Artificial Sequence
  siRNA Sense Sequence
agcugucuugugagggacu

SEQ ID NO: 3570 - RNA, 19 nt, Artificial Sequence
  siRNA Antisense Sequence
agucccucacaagacagcu

SEQ ID NO: 3571 - RNA, 19 nt, Artificial Sequence
  siRNA Sense Sequence
augcaggauuucuucacgc

SEQ ID NO: 3572 - RNA, 19 nt, Artificial Sequence
  siRNA Antisense Sequence
gcgugaagaaauccugcau

SEQ ID NO: 3573 - RNA, 19 nt, Artificial Sequence
  siRNA Sense Sequence
ugcaggauuucuucacgcc

SEQ ID NO: 3574 - RNA, 19 nt, Artificial Sequence
  siRNA Antisense Sequence
ggcgugaagaaauccugca

SEQ ID NO: 3575 - RNA, 19 nt, Artificial Sequence
  siRNA Antisense Sequence
gcaggauuucuucacgccu

SEQ ID NO: 3576 - RNA, 19 nt, Artificial Sequence
  siRNA Antisense Sequence
aggcgugaagaaauccugc

SEQ ID NO: 3577 - RNA, 19 nt, Artificial Sequence
  siRNA Sense Sequence
caggauuucuucacgccuc

SEQ ID NO: 3578 - RNA, 19 nt, Artificial Sequence
  siRNA Antisense Sequence
gaggcgugaagaaauccug

SEQ ID NO: 3579 - RNA, 19 nt, Artificial Sequence
  siRNA Sense Sequence
aggauuucuucacgccucc

SEQ ID NO: 3580 - RNA, 19 nt, Artificial Sequence
  siRNA Antisense Sequence
ggaggcgugaagaaauccu

SEQ ID NO: 3581 - RNA, 19 nt, Artificial Sequence
  siRNA Sense Sequence
ggauuucuucacgccuccc

SEQ ID NO: 3582 - RNA, 19 nt, Artificial Sequence
  siRNA Antisense Sequence
gggaggcgugaagaaaucc

SEQ ID NO: 3583 - RNA, 19 nt, Artificial Sequence
  siRNA Sense Sequence
ugacuucaagagccucugg

SEQ ID NO: 3584 - RNA, 19 nt, Artificial Sequence
  siRNA Antisense Sequence
ccagaggcucuugaaguca

SEQ ID NO: 3585 - RNA, 19 nt, Artificial Sequence
  siRNA Sense Sequence
acuucaagagccucuggca

SEQ ID NO: 3586 - RNA, 19 nt, Artificial Sequence
  siRNA Antisense Sequence
ugccagaggcucuugaagu

SEQ ID NO: 3587 - RNA, 19 nt, Artificial Sequence
  siRNA Sense Sequence
ucaagagccucuggcaucu

SEQ ID NO: 3588 - RNA, 19 nt, Artificial Sequence
  siRNA Antisense Sequence
agaugccagaggcucuuga

SEQ ID NO: 3589 - RNA, 19 nt, Artificial Sequence
  siRNA Sense Sequence
cuggcaucucuuucugcaa

SEQ ID NO: 3590 - RNA, 19 nt, Artificial Sequence
  siRNA Antisense Sequence
uugcagaaagagaugccag

SEQ ID NO: 3591 - RNA, 19 nt, Artificial Sequence
  siRNA Sense Sequence
caccugaaugugucugcgu

SEQ ID NO: 3592 - RNA, 19 nt, Artificial Sequence
  siRNA Antisense Sequence
acgcagacacauucaggug

SEQ ID NO: 3593 - RNA, 19 nt, Artificial Sequence
  siRNA Sense Sequence
accugaaugugucugcguc

SEQ ID NO: 3594 - RNA, 19 nt, Artificial Sequence
  siRNA Antisense Sequence
gacgcagacacauucaggu

SEQ ID NO: 3595 - RNA, 19 nt, Artificial Sequence
  siRNA Sense Sequence
ccugaaugugucugcgucc

SEQ ID NO: 3596 - RNA, 19 nt, Artificial Sequence
  siRNA Antisense Sequence
ggacgcagacacauucagg

SEQ ID NO: 3597 - RNA, 19 nt, Artificial Sequence
  siRNA Sense Sequence
aaugugucugcgucccugu

SEQ ID NO: 3598 - RNA, 19 nt, Artificial Sequence
  siRNA Antisense Sequence
acagggacgcagacacauu

SEQ ID NO: 3599 - RNA, 19 nt, Artificial Sequence
  siRNA Sense Sequence
augugucugcgucccuguu

SEQ ID NO: 3600 - RNA, 19 nt, Artificial Sequence
  siRNA Antisense Sequence
aacagggacgcagacacau

SEQ ID NO: 3601 - RNA, 19 nt, Artificial Sequence
  siRNA Sense Sequence
gugucugcgucccuguuag

SEQ ID NO: 3602 - RNA, 19 nt, Artificial Sequence
  siRNA Antisense Sequence
cuaacagggacgcagacac

SEQ ID NO: 3603 - RNA, 19 nt, Artificial Sequence
  siRNA Sense Sequence
ugucugcgucccuguuagc

SEQ ID NO: 3604 - RNA, 19 nt, Artificial Sequence
  siRNA Antisense Sequence
gcuaacagggacgcagaca

SEQ ID NO: 3605 - RNA, 19 nt, Artificial Sequence
  siRNA Sense Sequence
gucugcgucccuguuagca

SEQ ID NO: 3606 - RNA, 19 nt, Artificial Sequence
  siRNA Antisense Sequence
ugcuaacagggacgcagac

SEQ ID NO: 3607 - RNA, 19 nt, Artificial Sequence
  siRNA Sense Sequence
ucugcgucccuguuagcau

SEQ ID NO: 3608 - RNA, 19 nt, Artificial Sequence
  siRNA Antisense Sequence
augcuaacagggacgcaga

SEQ ID NO: 3609 - RNA, 19 nt, Artificial Sequence
  siRNA Sense Sequence
cugcgucccuguuagcaua

SEQ ID NO: 3610 - RNA, 19 nt, Artificial Sequence
  siRNA Antisense Sequence
uaugcuaacagggacgcag

SEQ ID NO: 3611 - RNA, 19 nt, Artificial Sequence
  siRNA Sense Sequence
ugcgucccuguuagcauaa

SEQ ID NO: 3612 - RNA, 19 nt, Artificial Sequence
  siRNA Antisense Sequence
uuaugcuaacagggacgca

SEQ ID NO: 3613 - RNA, 19 nt, Artificial Sequence
  siRNA Sense Sequence
gcgucccuguuagcauaau

SEQ ID NO: 3614 - RNA, 19 nt, Artificial Sequence
  siRNA Antisense Sequence
auuaugcuaacagggacgc

SEQ ID NO: 3615 - RNA, 19 nt, Artificial Sequence
  siRNA Sense Sequence
cgucccuguuagcauaaug

SEQ ID NO: 3616 - RNA, 19 nt, Artificial Sequence
  siRNA Antisense Sequence
cauuaugcuaacagggacg

SEQ ID NO: 3617 - RNA, 19 nt, Artificial Sequence
  siRNA Sense Sequence
uagcauaaugugaggaggu

SEQ ID NO: 3618 - RNA, 19 nt, Artificial Sequence
  siRNA Antisense Sequence
accuccucacauuaugcua

SEQ ID NO: 3619 - RNA, 19 nt, Artificial Sequence
  siRNA Sense Sequence
guucccaugcugaccugug

SEQ ID NO: 3620 - RNA, 19 nt, Artificial Sequence
  siRNA Antisense Sequence
cacaggucagcaugggaac

SEQ ID NO: 3621 - RNA, 19 nt, Artificial Sequence
  siRNA Sense Sequence
uucccaugcugaccugugu

SEQ ID NO: 3622 - RNA, 19 nt, Artificial Sequence
  siRNA Antisense Sequence
acacaggucagcaugggaa

SEQ ID NO: 3623 - RNA, 19 nt, Artificial Sequence
  siRNA Sense Sequence
ucccaugcugaccuguguu

SEQ ID NO: 3624 - RNA, 19 nt, Artificial Sequence
  siRNA Antisense Sequence
aacacaggucagcauggga

SEQ ID NO: 3625 - RNA, 19 nt, Artificial Sequence
  siRNA Sense Sequence
cccaugcugaccuguguuu

SEQ ID NO: 3626 - RNA, 19 nt, Artificial Sequence
  siRNA Antisense Sequence
aaacacaggucagcauggg

SEQ ID NO: 3627 - RNA, 19 nt, Artificial Sequence
  siRNA Sense Sequence
ccagucaucuuuccuguuc

SEQ ID NO: 3628 - RNA, 19 nt, Artificial Sequence
  siRNA Antisense Sequence
gaacaggaaagaugacugg

SEQ ID NO: 3629 - RNA, 19 nt, Artificial Sequence
  siRNA Sense Sequence
cagucaucuuuccuguucc

SEQ ID NO: 3630 - RNA, 19 nt, Artificial Sequence
  siRNA Antisense Sequence
ggaacaggaaagaugacug

SEQ ID NO: 3631 - RNA, 19 nt, Artificial Sequence
  siRNA Sense Sequence
agucaucuuuccuguucca

SEQ ID NO: 3632 - RNA, 19 nt, Artificial Sequence
  siRNA Antisense Sequence
uggaacaggaaagaugacu

SEQ ID NO: 3633 - RNA, 19 nt, Artificial Sequence
  siRNA Sense Sequence
ucugucucaacuuuaugug

SEQ ID NO: 3634 - RNA, 19 nt, Artificial Sequence
  siRNA Antisense Sequence
cacauaaaguugagacaga

SEQ ID NO: 3635 - RNA, 19 nt, Artificial Sequence
  siRNA Sense Sequence
cugucucaacuuuaugugc

SEQ ID NO: 3636 - RNA, 19 nt, Artificial Sequence
  siRNA Antisense Sequence
gcacauaaaguugagacag

SEQ ID NO: 3637 - RNA, 19 nt, Artificial Sequence
  siRNA Sense Sequence
ugucucaacuuuaugugca

SEQ ID NO: 3638 - RNA, 19 nt, Artificial Sequence
  siRNA Antisense Sequence
ugcacauaaaguugagaca

SEQ ID NO: 3639 - RNA, 19 nt, Artificial Sequence
  siRNA Sense Sequence
aacuuuaugugcacugagc

SEQ ID NO: 3640 - RNA, 19 nt, Artificial Sequence
  siRNA Antisense Sequence
gcucagugcacauaaaguu

SEQ ID NO: 3641 - RNA, 19 nt, Artificial Sequence
  siRNA Sense Sequence
acuuuaugugcacugagcu

SEQ ID NO: 3642 - RNA, 19 nt, Artificial Sequence
  siRNA Antisense Sequence
agcucagugcacauaaagu

SEQ ID NO: 3643 - RNA, 19 nt, Artificial Sequence
  siRNA Sense Sequence
acugagcugcaacuucuua

SEQ ID NO: 3644 - RNA, 19 nt, Artificial Sequence
  siRNA Antisense Sequence
uaagaaguugcagcucagu

SEQ ID NO: 3645 - RNA, 19 nt, Artificial Sequence
  siRNA Sense Sequence
ugagcugcaacuucuuacu

SEQ ID NO: 3646 - RNA, 19 nt, Artificial Sequence
  siRNA Antisense Sequence
aguaagaaguugcagcuca

SEQ ID NO: 3647 - RNA, 19 nt, Artificial Sequence
  siRNA Sense Sequence
gcugcaacuucuuacuucc

SEQ ID NO: 3648 - RNA, 19 nt, Artificial Sequence
  siRNA Antisense Sequence
ggaaguaagaaguugcagc

SEQ ID NO: 3649 - RNA, 19 nt, Artificial Sequence
  siRNA Sense Sequence
ugcaacuucuuacuucccu

SEQ ID NO: 3650 - RNA, 19 nt, Artificial Sequence
  siRNA Antisense Sequence
agggaaguaagaaguugca

SEQ ID NO: 3651 - RNA, 19 nt, Artificial Sequence
  siRNA Sense Sequence
aacuucuuacuucccuacu

SEQ ID NO: 3652 - RNA, 19 nt, Artificial Sequence
  siRNA Antisense Sequence
aguagggaaguaagaaguu

SEQ ID NO: 3653 - RNA, 19 nt, Artificial Sequence
  siRNA Sense Sequence
accuuccagaaucugcaug

SEQ ID NO: 3654 - RNA, 19 nt, Artificial Sequence
  siRNA Antisense Sequence
caugcagauucuggaaggu

SEQ ID NO: 3655 - RNA, 19 nt, Artificial Sequence
  siRNA Sense Sequence
cuuccagaaucugcauguu

SEQ ID NO: 3656 - RNA, 19 nt, Artificial Sequence
  siRNA Antisense Sequence
aacaugcagauucuggaag

SEQ ID NO: 3657 - RNA, 19 nt, Artificial Sequence
  siRNA Sense Sequence
uuccagaaucugcauguuc

SEQ ID NO: 3658 - RNA, 19 nt, Artificial Sequence
  siRNA Antisense Sequence
gaacaugcagauucuggaa

SEQ ID NO: 3659 - RNA, 19 nt, Artificial Sequence
  siRNA Sense Sequence
uccagaaucugcauguucg

SEQ ID NO: 3660 - RNA, 19 nt, Artificial Sequence
  siRNA Antisense Sequence
cgaacaugcagauucugga

SEQ ID NO: 3661 - RNA, 19 nt, Artificial Sequence
  siRNA Sense Sequence
ccagaaucugcauguucgc

SEQ ID NO: 3662 - RNA, 19 nt, Artificial Sequence
  siRNA Antisense Sequence
gcgaacaugcagauucugg

SEQ ID NO: 3663 - RNA, 19 nt, Artificial Sequence
  siRNA Sense Sequence
cagaaucugcauguucgcu

SEQ ID NO: 3664 - RNA, 19 nt, Artificial Sequence
  siRNA Antisense Sequence
agcgaacaugcagauucug

SEQ ID NO: 3665 - RNA, 19 nt, Artificial Sequence
  siRNA Sense Sequence
agaaucugcauguucgcug

SEQ ID NO: 3666 - RNA, 19 nt, Artificial Sequence
  siRNA Antisense Sequence
cagcgaacaugcagauucu

SEQ ID NO: 3667 - RNA, 19 nt, Artificial Sequence
  siRNA Sense Sequence
gaaucugcauguucgcugu

SEQ ID NO: 3668 - RNA, 19 nt, Artificial Sequence
  siRNA Antisense Sequence
acagcgaacaugcagauuc

SEQ ID NO: 3669 - RNA, 19 nt, Artificial Sequence
  siRNA Sense Sequence
aaucugcauguucgcugug

SEQ ID NO: 3670 - RNA, 19 nt, Artificial Sequence
  siRNA Antisense Sequence
cacagcgaacaugcagauu

SEQ ID NO: 3671 - RNA, 19 nt, Artificial Sequence
  siRNA Sense Sequence
uucgcugugcugagucugu

SEQ ID NO: 3672 - RNA, 19 nt, Artificial Sequence
  siRNA Antisense Sequence
acagacucagcacagcgaa

SEQ ID NO: 3673 - RNA, 19 nt, Artificial Sequence
  siRNA Sense Sequence
gcugagucuguugcaggug

SEQ ID NO: 3674 - RNA, 19 nt, Artificial Sequence
  siRNA Antisense Sequence
caccugcaacagacucagc

SEQ ID NO: 3675 - RNA, 19 nt, Artificial Sequence
  siRNA Antisense Sequence
ugagucuguugcagguggg

SEQ ID NO: 3676 - RNA, 19 nt, Artificial Sequence
  siRNA Antisense Sequence
cccaccugcaacagacuca

SEQ ID NO: 3677 - RNA, 19 nt, Artificial Sequence
  siRNA Sense Sequence
ggccugugcccauuuggug

SEQ ID NO: 3678 - RNA, 19 nt, Artificial Sequence
  siRNA Antisense Sequence
caccaaaugggcacaggcc

SEQ ID NO: 3679 - RNA, 19 nt, Artificial Sequence
  siRNA Sense Sequence
gccugugcccauuuggugu

SEQ ID NO: 3680 - RNA, 19 nt, Artificial Sequence
  siRNA Antisense Sequence
acaccaaaugggcacaggc

SEQ ID NO: 3681 - RNA, 19 nt, Artificial Sequence
  siRNA Sense Sequence
ccugugcccauuugguguu

SEQ ID NO: 3682 - RNA, 19 nt, Artificial Sequence
  siRNA Antisense Sequence
aacaccaaaugggcacagg

SEQ ID NO: 3683 - RNA, 19 nt, Artificial Sequence
  siRNA Sense Sequence
cugugcccauuugguguug

SEQ ID NO: 3684 - RNA, 19 nt, Artificial Sequence
  siRNA Antisense Sequence
caacaccaaaugggcacag

SEQ ID NO: 3685 - RNA, 19 nt, Artificial Sequence
  siRNA Sense Sequence
gcccauuugguguugaguc

SEQ ID NO: 3686 - RNA, 19 nt, Artificial Sequence
  siRNA Antisense Sequence
gacucaacaccaaaugggc

SEQ ID NO: 3687 - RNA, 19 nt, Artificial Sequence
  siRNA Sense Sequence
cccauuugguguugagucc

SEQ ID NO: 3688 - RNA, 19 nt, Artificial Sequence
  siRNA Antisense Sequence
ggacucaacaccaaauggg

SEQ ID NO: 3689 - RNA, 19 nt, Artificial Sequence
  siRNA Sense Sequence
ccauuugguguugagucca

SEQ ID NO: 3690 - RNA, 19 nt, Artificial Sequence
  siRNA Antisense Sequence
uggacucaacaccaaaugg

SEQ ID NO: 3691 - RNA, 19 nt, Artificial Sequence
  siRNA Sense Sequence
cauuugguguugaguccau

SEQ ID NO: 3692 - RNA, 19 nt, Artificial Sequence
  siRNA Antisense Sequence
auggacucaacaccaaaug

SEQ ID NO: 3693 - RNA, 19 nt, Artificial Sequence
  siRNA Sense Sequence
auuugguguugaguccauc

SEQ ID NO: 3694 - RNA, 19 nt, Artificial Sequence
  siRNA Antisense Sequence
gauggacucaacaccaaau

SEQ ID NO: 3695 - RNA, 19 nt, Artificial Sequence
  siRNA Sense Sequence
uuugguguugaguccauca

SEQ ID NO: 3696 - RNA, 19 nt, Artificial Sequence
  siRNA Antisense Sequence
ugauggacucaacaccaaa

SEQ ID NO: 3697 - RNA, 19 nt, Artificial Sequence
  siRNA Sense Sequence
uugguguugaguccaucau

SEQ ID NO: 3698 - RNA, 19 nt, Artificial Sequence
  siRNA Antisense Sequence
augauggacucaacaccaa

SEQ ID NO: 3699 - RNA, 19 nt, Artificial Sequence
  siRNA Sense Sequence
ugguguugaguccaucaug

SEQ ID NO: 3700 - RNA, 19 nt, Artificial Sequence
  siRNA Antisense Sequence
caugauggacucaacacca

SEQ ID NO: 3701 - RNA, 19 nt, Artificial Sequence
  siRNA Sense Sequence
gguguugaguccaucaugg

SEQ ID NO: 3702 - RNA, 19 nt, Artificial Sequence
  siRNA Antisense Sequence
ccaugauggacucaacacc

SEQ ID NO: 3703 - RNA, 19 nt, Artificial Sequence
  siRNA Sense Sequence
guguugaguccaucauggg

SEQ ID NO: 3704 - RNA, 19 nt, Artificial Sequence
  siRNA Antisense Sequence
cccaugauggacucaacac

SEQ ID NO: 3705 - RNA, 19 nt, Artificial Sequence
  siRNA Sense Sequence
uguugaguccaucaugggc

SEQ ID NO: 3706 - RNA, 19 nt, Artificial Sequence
  siRNA Antisense Sequence
gcccaugauggacucaaca

SEQ ID NO: 3707 - RNA, 19 nt, Artificial Sequence
  siRNA Sense Sequence
guugaguccaucaugggcu

SEQ ID NO: 3708 - RNA, 19 nt, Artificial Sequence
  siRNA Antisense Sequence
agcccaugauggacucaac

SEQ ID NO: 3709 - RNA, 19 nt, Artificial Sequence
  siRNA Sense Sequence
uugaguccaucaugggcuu

SEQ ID NO: 3710 - RNA, 19 nt, Artificial Sequence
  siRNA Antisense Sequence
aagcccaugauggacucaa

SEQ ID NO: 3711 - RNA, 19 nt, Artificial Sequence
  siRNA Sense Sequence
ugaguccaucaugggcuuu

SEQ ID NO: 3712 - RNA, 19 nt, Artificial Sequence
  siRNA Antisense Sequence
aaagcccaugauggacuca

SEQ ID NO: 3713 - RNA, 19 nt, Artificial Sequence
  siRNA Sense Sequence
ccaucaugggcuuuaugug

SEQ ID NO: 3714 - RNA, 19 nt, Artificial Sequence
  siRNA Antisense Sequence
cacauaaagcccaugaugg

SEQ ID NO: 3715 - RNA, 19 nt, Artificial Sequence
  siRNA Sense Sequence
caucaugggcuuuaugugg

SEQ ID NO: 3716 - RNA, 19 nt, Artificial Sequence
  siRNA Antisense Sequence
ccacauaaagcccaugaug

SEQ ID NO: 3717 - RNA, 19 nt, Artificial Sequence
  siRNA Sense Sequence
augggcuuuaugugguuag

SEQ ID NO: 3718 - RNA, 19 nt, Artificial Sequence
  siRNA Antisense Sequence
cuaaccacauaaagcccau

SEQ ID NO: 3719 - RNA, 19 nt, Artificial Sequence
  siRNA Sense Sequence
ugggcuuuaugugguuagu

SEQ ID NO: 3720 - RNA, 19 nt, Artificial Sequence
  siRNA Antisense Sequence
acuaaccacauaaagccca

SEQ ID NO: 3721 - RNA, 19 nt, Artificial Sequence
  siRNA Sense Sequence
gggcuuuaugugguuaguc

SEQ ID NO: 3722 - RNA, 19 nt, Artificial Sequence
  siRNA Antisense Sequence
gacuaaccacauaaagccc

SEQ ID NO: 3723 - RNA, 19 nt, Artificial Sequence
  siRNA Sense Sequence
ggcuuuaugugguuagucc

SEQ ID NO: 3724 - RNA, 19 nt, Artificial Sequence
  siRNA Antisense Sequence
ggacuaaccacauaaagcc

SEQ ID NO: 3725 - RNA, 19 nt, Artificial Sequence
  siRNA Sense Sequence
gcuuuaugugguuaguccu

SEQ ID NO: 3726 - RNA, 19 nt, Artificial Sequence
  siRNA Antisense Sequence
aggacuaaccacauaaagc

SEQ ID NO: 3727 - RNA, 19 nt, Artificial Sequence
  siRNA Sense Sequence
cuuuaugugguuaguccuc

SEQ ID NO: 3728 - RNA, 19 nt, Artificial Sequence
  siRNA Antisense Sequence
gaggacuaaccacauaaag

SEQ ID NO: 3729 - RNA, 19 nt, Artificial Sequence
  siRNA Sense Sequence
gugguuaguccucagcugg

SEQ ID NO: 3730 - RNA, 19 nt, Artificial Sequence
  siRNA Antisense Sequence
ccagcugaggacuaaccac

SEQ ID NO: 3731 - RNA, 19 nt, Artificial Sequence
  siRNA Sense Sequence
ugguuaguccucagcuggg

SEQ ID NO: 3732 - RNA, 19 nt, Artificial Sequence
  siRNA Antisense Sequence
cccagcugaggacuaacca

SEQ ID NO: 3733 - RNA, 19 nt, Artificial Sequence
  siRNA Sense Sequence
gguuaguccucagcugggu

SEQ ID NO: 3734 - RNA, 19 nt, Artificial Sequence
  siRNA Antisense Sequence
acccagcugaggacuaacc

SEQ ID NO: 3735 - RNA, 19 nt, Artificial Sequence
  siRNA Sense Sequence
guuaguccucagcuggguc

SEQ ID NO: 3736 - RNA, 19 nt, Artificial Sequence
  siRNA Antisense Sequence
gacccagcugaggacuaac

SEQ ID NO: 3737 - RNA, 19 nt, Artificial Sequence
  siRNA Sense Sequence
uuaguccucagcuggguca

SEQ ID NO: 3738 - RNA, 19 nt, Artificial Sequence
  siRNA Antisense Sequence
ugacccagcugaggacuaa

SEQ ID NO: 3739 - RNA, 19 nt, Artificial Sequence
  siRNA Sense Sequence
uaguccucagcugggucac

SEQ ID NO: 3740 - RNA, 19 nt, Artificial Sequence
  siRNA Antisense Sequence
gugacccagcugaggacua

SEQ ID NO: 3741 - RNA, 19 nt, Artificial Sequence
  siRNA Sense Sequence
guccucagcugggucaccu

SEQ ID NO: 3742 - RNA, 19 nt, Artificial Sequence
  siRNA Antisense Sequence
aggugacccagcugaggac

SEQ ID NO: 3743 - RNA, 19 nt, Artificial Sequence
  siRNA Sense Sequence
cagcugggucaccuucacu

SEQ ID NO: 3744 - RNA, 19 nt, Artificial Sequence
  siRNA Antisense Sequence
agugaaggugacccagcug

SEQ ID NO: 3745 - RNA, 19 nt, Artificial Sequence
  siRNA Sense Sequence
cugggucaccuucacugcu

SEQ ID NO: 3746 - RNA, 19 nt, Artificial Sequence
  siRNA Antisense Sequence
agcagugaaggugacccag

SEQ ID NO: 3747 - RNA, 19 nt, Artificial Sequence
  siRNA Sense Sequence
gggucaccuucacugcucc

SEQ ID NO: 3748 - RNA, 19 nt, Artificial Sequence
  siRNA Antisense Sequence
ggagcagugaaggugaccc

SEQ ID NO: 3749 - RNA, 19 nt, Artificial Sequence
  siRNA Sense Sequence
uucacugcuccauuguccu

SEQ ID NO: 3750 - RNA, 19 nt, Artificial Sequence
  siRNA Antisense Sequence
aggacaauggagcagugaa

SEQ ID NO: 3751 - RNA, 19 nt, Artificial Sequence
  siRNA Sense Sequence
ugcuccauuguccuugucc

SEQ ID NO: 3752 - RNA, 19 nt, Artificial Sequence
  siRNA Antisense Sequence
ggacaaggacaauggagca

SEQ ID NO: 3753 - RNA, 19 nt, Artificial Sequence
  siRNA Sense Sequence
cuccauuguccuugucccu

SEQ ID NO: 3754 - RNA, 19 nt, Artificial Sequence
  siRNA Antisense Sequence
agggacaaggacaauggag

SEQ ID NO: 3755 - RNA, 19 nt, Artificial Sequence
  siRNA Sense Sequence
cauuguccuugucccuuca

SEQ ID NO: 3756 - RNA, 19 nt, Artificial Sequence
  siRNA Antisense Sequence
ugaagggacaaggacaaug

SEQ ID NO: 3757 - RNA, 19 nt, Artificial Sequence
  siRNA Sense Sequence
uuguccuugucccuucagu

SEQ ID NO: 3758 - RNA, 19 nt, Artificial Sequence
  siRNA Antisense Sequence
acugaagggacaaggacaa

SEQ ID NO: 3759 - RNA, 19 nt, Artificial Sequence
  siRNA Sense Sequence
uccuugucccuucagugga

SEQ ID NO: 3760 - RNA, 19 nt, Artificial Sequence
  siRNA Antisense Sequence
uccacugaagggacaagga

SEQ ID NO: 3761 - RNA, 19 nt, Artificial Sequence
  siRNA Sense Sequence
aacuuguccagcgggagcu

SEQ ID NO: 3762 - RNA, 19 nt, Artificial Sequence
  siRNA Antisense Sequence
agcucccgcuggacaaguu

SEQ ID NO: 3763 - RNA, 19 nt, Artificial Sequence
  siRNA Sense Sequence
agcgggagcugugaccaca

SEQ ID NO: 3764 - RNA, 19 nt, Artificial Sequence
  siRNA Antisense Sequence
uguggucacagcucccgcu

SEQ ID NO: 3765 - RNA, 19 nt, Artificial Sequence
  siRNA Sense Sequence
ugaccacagaggcucacac

SEQ ID NO: 3766 - RNA, 19 nt, Artificial Sequence
  siRNA Antisense Sequence
gugugagccucugugguca

SEQ ID NO: 3767 - RNA, 19 nt, Artificial Sequence
  siRNA Sense Sequence
aaauuuucagagccauuca

SEQ ID NO: 3768 - RNA, 19 nt, Artificial Sequence
  siRNA Antisense Sequence
ugaauggcucugaaaauuu

SEQ ID NO: 3769 - RNA, 19 nt, Artificial Sequence
  siRNA Sense Sequence
ccauucaccucuugcccug

SEQ ID NO: 3770 - RNA, 19 nt, Artificial Sequence
  siRNA Antisense Sequence
cagggcaagaggugaaugg

SEQ ID NO: 3771 - RNA, 19 nt, Artificial Sequence
  siRNA Sense Sequence
ucaccucuugcccugcuuc

SEQ ID NO: 3772 - RNA, 19 nt, Artificial Sequence
  siRNA Antisense Sequence
gaagcagggcaagagguga

SEQ ID NO: 3773 - RNA, 19 nt, Artificial Sequence
  siRNA Sense Sequence
caccucuugcccugcuucu

SEQ ID NO: 3774 - RNA, 19 nt, Artificial Sequence
  siRNA Antisense Sequence
agaagcagggcaagaggug

SEQ ID NO: 3775 - RNA, 19 nt, Artificial Sequence
  siRNA Antisense Sequence
accucuugcccugcuucua

SEQ ID NO: 3776 - RNA, 19 nt, Artificial Sequence
  siRNA Antisense Sequence
uagaagcagggcaagaggu

SEQ ID NO: 3777 - RNA, 19 nt, Artificial Sequence
  siRNA Sense Sequence
ccucuugcccugcuucuag

SEQ ID NO: 3778 - RNA, 19 nt, Artificial Sequence
  siRNA Antisense Sequence
cuagaagcagggcaagagg

SEQ ID NO: 3779 - RNA, 19 nt, Artificial Sequence
  siRNA Sense Sequence
cucuugcccugcuucuaga

SEQ ID NO: 3780 - RNA, 19 nt, Artificial Sequence
  siRNA Antisense Sequence
ucuagaagcagggcaagag

SEQ ID NO: 3781 - RNA, 19 nt, Artificial Sequence
  siRNA Sense Sequence
ucuugcccugcuucuagag

SEQ ID NO: 3782 - RNA, 19 nt, Artificial Sequence
  siRNA Antisense Sequence
cucuagaagcagggcaaga

SEQ ID NO: 3783 - RNA, 19 nt, Artificial Sequence
  siRNA Sense Sequence
cuugcccugcuucuagagc

SEQ ID NO: 3784 - RNA, 19 nt, Artificial Sequence
  siRNA Antisense Sequence
gcucuagaagcagggcaag

SEQ ID NO: 3785 - RNA, 19 nt, Artificial Sequence
  siRNA Sense Sequence
uugcccugcuucuagagcu

SEQ ID NO: 3786 - RNA, 19 nt, Artificial Sequence
  siRNA Antisense Sequence
agcucuagaagcagggcaa

SEQ ID NO: 3787 - RNA, 19 nt, Artificial Sequence
  siRNA Sense Sequence
ugcccugcuucuagagcuc

SEQ ID NO: 3788 - RNA, 19 nt, Artificial Sequence
  siRNA Antisense Sequence
gagcucuagaagcagggca

SEQ ID NO: 3789 - RNA, 19 nt, Artificial Sequence
  siRNA Sense Sequence
gcccugcuucuagagcucc

SEQ ID NO: 3790 - RNA, 19 nt, Artificial Sequence
  siRNA Antisense Sequence
ggagcucuagaagcagggc

SEQ ID NO: 3791 - RNA, 19 nt, Artificial Sequence
  siRNA Sense Sequence
ugcuucuagagcuccuuuu

SEQ ID NO: 3792 - RNA, 19 nt, Artificial Sequence
  siRNA Antisense Sequence
aaaaggagcucuagaagca

SEQ ID NO: 3793 - RNA, 19 nt, Artificial Sequence
  siRNA Sense Sequence
gcuucuagagcuccuuuuc

SEQ ID NO: 3794 - RNA, 19 nt, Artificial Sequence
  siRNA Antisense Sequence
gaaaaggagcucuagaagc

SEQ ID NO: 3795 - RNA, 19 nt, Artificial Sequence
  siRNA Sense Sequence
cuucuagagcuccuuuucu

SEQ ID NO: 3796 - RNA, 19 nt, Artificial Sequence
  siRNA Antisense Sequence
agaaaaggagcucuagaag

SEQ ID NO: 3797 - RNA, 19 nt, Artificial Sequence
  siRNA Sense Sequence
uucuagagcuccuuuucug

SEQ ID NO: 3798 - RNA, 19 nt, Artificial Sequence
  siRNA Antisense Sequence
cagaaaaggagcucuagaa

SEQ ID NO: 3799 - RNA, 19 nt, Artificial Sequence
  siRNA Sense Sequence
cuagagcuccuuuucugcu

SEQ ID NO: 3800 - RNA, 19 nt, Artificial Sequence
  siRNA Antisense Sequence
agcagaaaaggagcucuag

SEQ ID NO: 3801 - RNA, 19 nt, Artificial Sequence
  siRNA Sense Sequence
ccuuuucugcucugcucuc

SEQ ID NO: 3802 - RNA, 19 nt, Artificial Sequence
  siRNA Antisense Sequence
gagagcagagcagaaaagg

SEQ ID NO: 3803 - RNA, 19 nt, Artificial Sequence
  siRNA Sense Sequence
uucugcucugcucuccugc

SEQ ID NO: 3804 - RNA, 19 nt, Artificial Sequence
  siRNA Antisense Sequence
gcaggagagcagagcagaa

SEQ ID NO: 3805 - RNA, 19 nt, Artificial Sequence
  siRNA Sense Sequence
ucugcucugcucuccugcc

SEQ ID NO: 3806 - RNA, 19 nt, Artificial Sequence
  siRNA Antisense Sequence
ggcaggagagcagagcaga

SEQ ID NO: 3807 - RNA, 19 nt, Artificial Sequence
  siRNA Sense Sequence
ugcucugcucuccugcccu

SEQ ID NO: 3808 - RNA, 19 nt, Artificial Sequence
  siRNA Antisense Sequence
agggcaggagagcagagca

SEQ ID NO: 3809 - RNA, 19 nt, Artificial Sequence
  siRNA Sense Sequence
cucugcucuccugcccucu

SEQ ID NO: 3810 - RNA, 19 nt, Artificial Sequence
  siRNA Antisense Sequence
agagggcaggagagcagag

SEQ ID NO: 3811 - RNA, 19 nt, Artificial Sequence
  siRNA Sense Sequence
ucugcucuccugcccucuc

SEQ ID NO: 3812 - RNA, 19 nt, Artificial Sequence
  siRNA Antisense Sequence
gagagggcaggagagcaga

SEQ ID NO: 3813 - RNA, 19 nt, Artificial Sequence
  siRNA Sense Sequence
cugcucuccugcccucucu

SEQ ID NO: 3814 - RNA, 19 nt, Artificial Sequence
  siRNA Antisense Sequence
agagagggcaggagagcag

SEQ ID NO: 3815 - RNA, 19 nt, Artificial Sequence
  siRNA Sense Sequence
ucucccugcccugguucua

SEQ ID NO: 3816 - RNA, 19 nt, Artificial Sequence
  siRNA Antisense Sequence
uagaaccagggcagggaga

SEQ ID NO: 3817 - RNA, 19 nt, Artificial Sequence
  siRNA Sense Sequence
cccugguucuagugaucuu

SEQ ID NO: 3818 - RNA, 19 nt, Artificial Sequence
  siRNA Antisense Sequence
aagaucacuagaaccaggg

SEQ ID NO: 3819 - RNA, 19 nt, Artificial Sequence
  siRNA Sense Sequence
ccugguucuagugaucuug

SEQ ID NO: 3820 - RNA, 19 nt, Artificial Sequence
  siRNA Antisense Sequence
caagaucacuagaaccagg

SEQ ID NO: 3821 - RNA, 19 nt, Artificial Sequence
  siRNA Sense Sequence
cugguucuagugaucuugg

SEQ ID NO: 3822 - RNA, 19 nt, Artificial Sequence
  siRNA Antisense Sequence
ccaagaucacuagaaccag

SEQ ID NO: 3823 - RNA, 19 nt, Artificial Sequence
  siRNA Sense Sequence
ugguucuagugaucuuggu

SEQ ID NO: 3824 - RNA, 19 nt, Artificial Sequence
  siRNA Antisense Sequence
accaagaucacuagaacca

SEQ ID NO: 3825 - RNA, 19 nt, Artificial Sequence
  siRNA Sense Sequence
gguucuagugaucuuggug

SEQ ID NO: 3826 - RNA, 19 nt, Artificial Sequence
  siRNA Antisense Sequence
caccaagaucacuagaacc

SEQ ID NO: 3827 - RNA, 19 nt, Artificial Sequence
  siRNA Sense Sequence
gaucuuggugcugaaucca

SEQ ID NO: 3828 - RNA, 19 nt, Artificial Sequence
  siRNA Antisense Sequence
uggauucagcaccaagauc

SEQ ID NO: 3829 - RNA, 19 nt, Artificial Sequence
  siRNA Sense Sequence
uggugcugaauccaauccc

SEQ ID NO: 3830 - RNA, 19 nt, Artificial Sequence
  siRNA Antisense Sequence
gggauuggauucagcacca

SEQ ID NO: 3831 - RNA, 19 nt, Artificial Sequence
  siRNA Sense Sequence
gcugaauccaaucccaacu

SEQ ID NO: 3832 - RNA, 19 nt, Artificial Sequence
  siRNA Antisense Sequence
aguugggauuggauucagc

SEQ ID NO: 3833 - RNA, 19 nt, Artificial Sequence
  siRNA Sense Sequence
aauccaaucccaacucaug

SEQ ID NO: 3834 - RNA, 19 nt, Artificial Sequence
  siRNA Antisense Sequence
caugaguugggauuggauu

SEQ ID NO: 3835 - RNA, 19 nt, Artificial Sequence
  siRNA Sense Sequence
aucccaacucaugaaucug

SEQ ID NO: 3836 - RNA, 19 nt, Artificial Sequence
  siRNA Antisense Sequence
cagauucaugaguugggau

SEQ ID NO: 3837 - RNA, 19 nt, Artificial Sequence
  siRNA Sense Sequence
ucccaacucaugaaucugu

SEQ ID NO: 3838 - RNA, 19 nt, Artificial Sequence
  siRNA Antisense Sequence
acagauucaugaguuggga

SEQ ID NO: 3839 - RNA, 19 nt, Artificial Sequence
  siRNA Sense Sequence
cccaacucaugaaucugua

SEQ ID NO: 3840 - RNA, 19 nt, Artificial Sequence
  siRNA Antisense Sequence
uacagauucaugaguuggg

SEQ ID NO: 3841 - RNA, 19 nt, Artificial Sequence
  siRNA Sense Sequence
ccaacucaugaaucuguaa

SEQ ID NO: 3842 - RNA, 19 nt, Artificial Sequence
  siRNA Antisense Sequence
uuacagauucaugaguugg

SEQ ID NO: 3843 - RNA, 19 nt, Artificial Sequence
  siRNA Sense Sequence
caacucaugaaucuguaaa

SEQ ID NO: 3844 - RNA, 19 nt, Artificial Sequence
  siRNA Antisense Sequence
uuuacagauucaugaguug

SEQ ID NO: 3845 - RNA, 19 nt, Artificial Sequence
  siRNA Sense Sequence
acucaugaaucuguaaagc

SEQ ID NO: 3846 - RNA, 19 nt, Artificial Sequence
  siRNA Antisense Sequence
gcuuuacagauucaugagu

SEQ ID NO: 3847 - RNA, 19 nt, Artificial Sequence
  siRNA Sense Sequence
cucaugaaucuguaaagca

SEQ ID NO: 3848 - RNA, 19 nt, Artificial Sequence
  siRNA Antisense Sequence
ugcuuuacagauucaugag

SEQ ID NO: 3849 - RNA, 19 nt, Artificial Sequence
  siRNA Sense Sequence
ucaugaaucuguaaagcag

SEQ ID NO: 3850 - RNA, 19 nt, Artificial Sequence
  siRNA Antisense Sequence
cugcuuuacagauucauga

SEQ ID NO: 3851 - RNA, 19 nt, Artificial Sequence
  siRNA Sense Sequence
guaaagcagagucuaauuu

SEQ ID NO: 3852 - RNA, 19 nt, Artificial Sequence
  siRNA Antisense Sequence
aaauuagacucugcuuuac

SEQ ID NO: 3853 - RNA, 19 nt, Artificial Sequence
  siRNA Sense Sequence
aaauuggacccgucaucaa

SEQ ID NO: 3854 - RNA, 19 nt, Artificial Sequence
  siRNA Antisense Sequence
uugaugacggguccaauuu

SEQ ID NO: 3855 - RNA, 19 nt, Artificial Sequence
  siRNA Sense Sequence
aauuggacccgucaucaag

SEQ ID NO: 3856 - RNA, 19 nt, Artificial Sequence
  siRNA Antisense Sequence
cuugaugacggguccaauu

SEQ ID NO: 3857 - RNA, 19 nt, Artificial Sequence
  siRNA Sense Sequence
auuggacccgucaucaagg

SEQ ID NO: 3858 - RNA, 19 nt, Artificial Sequence
  siRNA Antisense Sequence
ccuugaugacggguccaau

SEQ ID NO: 3859 - RNA, 19 nt, Artificial Sequence
  siRNA Sense Sequence
uuggacccgucaucaagga

SEQ ID NO: 3860 - RNA, 19 nt, Artificial Sequence
  siRNA Antisense Sequence
uccuugaugacggguccaa

SEQ ID NO: 3861 - RNA, 19 nt, Artificial Sequence
  siRNA Sense Sequence
uggacccgucaucaaggac

SEQ ID NO: 3862 - RNA, 19 nt, Artificial Sequence
  siRNA Antisense Sequence
guccuugaugacgggucca

SEQ ID NO: 3863 - RNA, 19 nt, Artificial Sequence
  siRNA Sense Sequence
ggacccgucaucaaggacu

SEQ ID NO: 3864 - RNA, 19 nt, Artificial Sequence
  siRNA Antisense Sequence
aguccuugaugacgggucc

SEQ ID NO: 3865 - RNA, 19 nt, Artificial Sequence
  siRNA Sense Sequence
gucaucaaggacuguucuu

SEQ ID NO: 3866 - RNA, 19 nt, Artificial Sequence
  siRNA Antisense Sequence
aagaacaguccuugaugac

SEQ ID NO: 3867 - RNA, 19 nt, Artificial Sequence
  siRNA Sense Sequence
ggacuguucuuuccugaag

SEQ ID NO: 3868 - RNA, 19 nt, Artificial Sequence
  siRNA Antisense Sequence
cuucaggaaagaacagucc

SEQ ID NO: 3869 - RNA, 19 nt, Artificial Sequence
  siRNA Sense Sequence
auugugugcugcagugugc

SEQ ID NO: 3870 - RNA, 19 nt, Artificial Sequence
  siRNA Antisense Sequence
gcacacugcagcacacaau

SEQ ID NO: 3871 - RNA, 20 nt, Artificial Sequence
  Antisense Sequence
gagaaaagaaacugcggagu

SEQ ID NO: 3872 - RNA, 20 nt, Artificial Sequence
  Antisense Sequence
ggagaaaagaaacugcggag

SEQ ID NO: 3873 - RNA, 20 nt, Artificial Sequence
  Antisense Sequence
gggagaaaagaaacugcgga

SEQ ID NO: 3874 - RNA, 20 nt, Artificial Sequence
  Antisense Sequence
agguuggcagagggagaaaa

SEQ ID NO: 3875 - RNA, 20 nt, Artificial Sequence
  Antisense Sequence
uagguuggcagagggagaaa

SEQ ID NO: 3876 - RNA, 20 nt, Artificial Sequence
  Antisense Sequence
auagguuggcagagggagaa

SEQ ID NO: 3877 - RNA, 20 nt, Artificial Sequence
  Antisense Sequence
cauagguuggcagagggaga

SEQ ID NO: 3878 - RNA, 20 nt, Artificial Sequence
  Antisense Sequence
acauagguuggcagagggag

SEQ ID NO: 3879 - RNA, 20 nt, Artificial Sequence
  Antisense Sequence
uacauagguuggcagaggga

SEQ ID NO: 3880 - RNA, 20 nt, Artificial Sequence
  Antisense Sequence
cuacauagguuggcagaggg

SEQ ID NO: 3881 - RNA, 20 nt, Artificial Sequence
  Antisense Sequence
ccuacauagguuggcagagg

SEQ ID NO: 3882 - RNA, 20 nt, Artificial Sequence
  Antisense Sequence
cccuacauagguuggcagag

SEQ ID NO: 3883 - RNA, 20 nt, Artificial Sequence
  Antisense Sequence
acccuacauagguuggcaga

SEQ ID NO: 3884 - RNA, 20 nt, Artificial Sequence
  Antisense Sequence
gacccuacauagguuggcag

SEQ ID NO: 3885 - RNA, 20 nt, Artificial Sequence
  Antisense Sequence
ggacccuacauagguuggca

SEQ ID NO: 3886 - RNA, 20 nt, Artificial Sequence
  Antisense Sequence
aggacccuacauagguuggc

SEQ ID NO: 3887 - RNA, 20 nt, Artificial Sequence
  Antisense Sequence
aaggacccuacauagguugg

SEQ ID NO: 3888 - RNA, 20 nt, Artificial Sequence
  Antisense Sequence
gaaggacccuacauagguug

SEQ ID NO: 3889 - RNA, 20 nt, Artificial Sequence
  Antisense Sequence
agaaggacccuacauagguu

SEQ ID NO: 3890 - RNA, 20 nt, Artificial Sequence
  Antisense Sequence
aagaaggacccuacauaggu

SEQ ID NO: 3891 - RNA, 20 nt, Artificial Sequence
  Antisense Sequence
gaagaaggacccuacauagg

SEQ ID NO: 3892 - RNA, 20 nt, Artificial Sequence
  Antisense Sequence
ggaagaaggacccuacauag

SEQ ID NO: 3893 - RNA, 20 nt, Artificial Sequence
  Antisense Sequence
cgucgugaguauccaggaag

SEQ ID NO: 3894 - RNA, 20 nt, Artificial Sequence
  Antisense Sequence
gcgucgugaguauccaggaa

SEQ ID NO: 3895 - RNA, 20 nt, Artificial Sequence
  Antisense Sequence
cgcgucgugaguauccagga

SEQ ID NO: 3896 - RNA, 20 nt, Artificial Sequence
  Antisense Sequence
uccgcgucgugaguauccag

SEQ ID NO: 3897 - RNA, 20 nt, Artificial Sequence
  Antisense Sequence
guccgcgucgugaguaucca

SEQ ID NO: 3898 - RNA, 20 nt, Artificial Sequence
  Antisense Sequence
uggguccgcgucgugaguau

SEQ ID NO: 3899 - RNA, 20 nt, Artificial Sequence
  Antisense Sequence
gacacccaaugggagugaga

SEQ ID NO: 3900 - RNA, 20 nt, Artificial Sequence
  Antisense Sequence
cgacacccaaugggagugag

SEQ ID NO: 3901 - RNA, 20 nt, Artificial Sequence
  Antisense Sequence
aaacccgacacccaauggga

SEQ ID NO: 3902 - RNA, 20 nt, Artificial Sequence
  Antisense Sequence
gaaacccgacacccaauggg

SEQ ID NO: 3903 - RNA, 20 nt, Artificial Sequence
  Antisense Sequence
uggaaacccgacacccaaug

SEQ ID NO: 3904 - RNA, 20 nt, Artificial Sequence
  Antisense Sequence
cuggaaacccgacacccaau

SEQ ID NO: 3905 - RNA, 20 nt, Artificial Sequence
  Antisense Sequence
ucuggaaacccgacacccaa

SEQ ID NO: 3906 - RNA, 20 nt, Artificial Sequence
  Antisense Sequence
cucuggaaacccgacaccca

SEQ ID NO: 3907 - RNA, 20 nt, Artificial Sequence
  Antisense Sequence
ucucuggaaacccgacaccc

SEQ ID NO: 3908 - RNA, 20 nt, Artificial Sequence
  Antisense Sequence
uucucuggaaacccgacacc

SEQ ID NO: 3909 - RNA, 20 nt, Artificial Sequence
  Antisense Sequence
cuucucuggaaacccgacac

SEQ ID NO: 3910 - RNA, 20 nt, Artificial Sequence
  Antisense Sequence
uggcuucucuggaaacccga

SEQ ID NO: 3911 - RNA, 20 nt, Artificial Sequence
  Antisense Sequence
uuggcuucucuggaaacccg

SEQ ID NO: 3912 - RNA, 20 nt, Artificial Sequence
  Antisense Sequence
gacacugauuggcuucucug

SEQ ID NO: 3913 - RNA, 20 nt, Artificial Sequence
  Antisense Sequence
cgacgacacugauuggcuuc

SEQ ID NO: 3914 - RNA, 20 nt, Artificial Sequence
  Antisense Sequence
gcgacgacacugauuggcuu

SEQ ID NO: 3915 - RNA, 20 nt, Artificial Sequence
  Antisense Sequence
cgcgacgacacugauuggcu

SEQ ID NO: 3916 - RNA, 20 nt, Artificial Sequence
  Antisense Sequence
accgcgacgacacugauugg

SEQ ID NO: 3917 - RNA, 20 nt, Artificial Sequence
  Antisense Sequence
gaccgcgacgacacugauug

SEQ ID NO: 3918 - RNA, 20 nt, Artificial Sequence
  Antisense Sequence
cgaccgcgacgacacugauu

SEQ ID NO: 3919 - RNA, 20 nt, Artificial Sequence
  Antisense Sequence
uuuagaaccgcgaccgcgac

SEQ ID NO: 3920 - RNA, 20 nt, Artificial Sequence
  Antisense Sequence
cuuuagaaccgcgaccgcga

SEQ ID NO: 3921 - RNA, 20 nt, Artificial Sequence
  Antisense Sequence
acuuuagaaccgcgaccgcg

SEQ ID NO: 3922 - RNA, 20 nt, Artificial Sequence
  Antisense Sequence
gacuuuagaaccgcgaccgc

SEQ ID NO: 3923 - RNA, 20 nt, Artificial Sequence
  Antisense Sequence
ggacuuuagaaccgcgaccg

SEQ ID NO: 3924 - RNA, 20 nt, Artificial Sequence
  Antisense Sequence
cggacuuuagaaccgcgacc

SEQ ID NO: 3925 - RNA, 20 nt, Artificial Sequence
  Antisense Sequence
gcgugcggacuuuagaaccg

SEQ ID NO: 3926 - RNA, 20 nt, Artificial Sequence
  Antisense Sequence
ugcgugcggacuuuagaacc

SEQ ID NO: 3927 - RNA, 20 nt, Artificial Sequence
  Antisense Sequence
gugcgugcggacuuuagaac

SEQ ID NO: 3928 - RNA, 20 nt, Artificial Sequence
  Antisense Sequence
ggugcgugcggacuuuagaa

SEQ ID NO: 3929 - RNA, 20 nt, Artificial Sequence
  Antisense Sequence
gggugcgugcggacuuuaga

SEQ ID NO: 3930 - RNA, 20 nt, Artificial Sequence
  Antisense Sequence
ugggugcgugcggacuuuag

SEQ ID NO: 3931 - RNA, 20 nt, Artificial Sequence
  Antisense Sequence
gugggugcgugcggacuuua

SEQ ID NO: 3932 - RNA, 20 nt, Artificial Sequence
  Antisense Sequence
caagaguagcaggaggaggg

SEQ ID NO: 3933 - RNA, 20 nt, Artificial Sequence
  Antisense Sequence
ccaagaguagcaggaggagg

SEQ ID NO: 3934 - RNA, 20 nt, Artificial Sequence
  Antisense Sequence
cccaagaguagcaggaggag

SEQ ID NO: 3935 - RNA, 20 nt, Artificial Sequence
  Antisense Sequence
uguggugaaauaccucaugg

SEQ ID NO: 3936 - RNA, 20 nt, Artificial Sequence
  Antisense Sequence
auguggugaaauaccucaug

SEQ ID NO: 3937 - RNA, 20 nt, Artificial Sequence
  Antisense Sequence
gauguggugaaauaccucau

SEQ ID NO: 3938 - RNA, 20 nt, Artificial Sequence
  Antisense Sequence
ggauguggugaaauaccuca

SEQ ID NO: 3939 - RNA, 20 nt, Artificial Sequence
  Antisense Sequence
cggauguggugaaauaccuc

SEQ ID NO: 3940 - RNA, 20 nt, Artificial Sequence
  Antisense Sequence
acggauguggugaaauaccu

SEQ ID NO: 3941 - RNA, 20 nt, Artificial Sequence
  Antisense Sequence
cacggauguggugaaauacc

SEQ ID NO: 3942 - RNA, 20 nt, Artificial Sequence
  Antisense Sequence
acacggauguggugaaauac

SEQ ID NO: 3943 - RNA, 20 nt, Artificial Sequence
  Antisense Sequence
gacacggauguggugaaaua

SEQ ID NO: 3944 - RNA, 20 nt, Artificial Sequence
  Antisense Sequence
ggacacggauguggugaaau

SEQ ID NO: 3945 - RNA, 20 nt, Artificial Sequence
  Antisense Sequence
gggacacggauguggugaaa

SEQ ID NO: 3946 - RNA, 20 nt, Artificial Sequence
  Antisense Sequence
cgggacacggauguggugaa

SEQ ID NO: 3947 - RNA, 20 nt, Artificial Sequence
  Antisense Sequence
ugucaaaccgcacgaacugc

SEQ ID NO: 3948 - RNA, 20 nt, Artificial Sequence
  Antisense Sequence
cugucaaaccgcacgaacug

SEQ ID NO: 3949 - RNA, 20 nt, Artificial Sequence
  Antisense Sequence
gcugucaaaccgcacgaacu

SEQ ID NO: 3950 - RNA, 20 nt, Artificial Sequence
  Antisense Sequence
cgcugucaaaccgcacgaac

SEQ ID NO: 3951 - RNA, 20 nt, Artificial Sequence
  Antisense Sequence
ucgcugucaaaccgcacgaa

SEQ ID NO: 3952 - RNA, 20 nt, Artificial Sequence
  Antisense Sequence
gucgcugucaaaccgcacga

SEQ ID NO: 3953 - RNA, 20 nt, Artificial Sequence
  Antisense Sequence
cuccugcucuauccacggug

SEQ ID NO: 3954 - RNA, 20 nt, Artificial Sequence
  Antisense Sequence
ccuccugcucuauccacggu

SEQ ID NO: 3955 - RNA, 20 nt, Artificial Sequence
  Antisense Sequence
ugcaggucccaauacuccgg

SEQ ID NO: 3956 - RNA, 20 nt, Artificial Sequence
  Antisense Sequence
cuucacauuccgugucugca

SEQ ID NO: 3957 - RNA, 20 nt, Artificial Sequence
  Antisense Sequence
ccuucacauuccgugucugc

SEQ ID NO: 3958 - RNA, 20 nt, Artificial Sequence
  Antisense Sequence
gccuucacauuccgugucug

SEQ ID NO: 3959 - RNA, 20 nt, Artificial Sequence
  Antisense Sequence
gggccuucacauuccguguc

SEQ ID NO: 3960 - RNA, 20 nt, Artificial Sequence
  Antisense Sequence
ugggccuucacauuccgugu

SEQ ID NO: 3961 - RNA, 20 nt, Artificial Sequence
  Antisense Sequence
acugggccuucacauuccgu

SEQ ID NO: 3962 - RNA, 20 nt, Artificial Sequence
  Antisense Sequence
gacugggccuucacauuccg

SEQ ID NO: 3963 - RNA, 20 nt, Artificial Sequence
  Antisense Sequence
uucgcucggucagucuguga

SEQ ID NO: 3964 - RNA, 20 nt, Artificial Sequence
  Antisense Sequence
guucgcucggucagucugug

SEQ ID NO: 3965 - RNA, 20 nt, Artificial Sequence
  Antisense Sequence
gguucgcucggucagucugu

SEQ ID NO: 3966 - RNA, 20 nt, Artificial Sequence
  Antisense Sequence
agguucgcucggucagucug

SEQ ID NO: 3967 - RNA, 20 nt, Artificial Sequence
  Antisense Sequence
cagguucgcucggucagucu

SEQ ID NO: 3968 - RNA, 20 nt, Artificial Sequence
  Antisense Sequence
uggauggugugagaaccggc

SEQ ID NO: 3969 - RNA, 20 nt, Artificial Sequence
  Antisense Sequence
cuggauggugugagaaccgg

SEQ ID NO: 3970 - RNA, 20 nt, Artificial Sequence
  Antisense Sequence
ucuggauggugugagaaccg

SEQ ID NO: 3971 - RNA, 20 nt, Artificial Sequence
  Antisense Sequence
cagccauacaucaucuggau

SEQ ID NO: 3972 - RNA, 20 nt, Artificial Sequence
  Antisense Sequence
gcagccauacaucaucugga

SEQ ID NO: 3973 - RNA, 20 nt, Artificial Sequence
  Antisense Sequence
cgcagccauacaucaucugg

SEQ ID NO: 3974 - RNA, 20 nt, Artificial Sequence
  Antisense Sequence
ucgcagccauacaucaucug

SEQ ID NO: 3975 - RNA, 20 nt, Artificial Sequence
  Antisense Sequence
gucgcagccauacaucaucu

SEQ ID NO: 3976 - RNA, 20 nt, Artificial Sequence
  Antisense Sequence
cgucgcagccauacaucauc

SEQ ID NO: 3977 - RNA, 20 nt, Artificial Sequence
  Antisense Sequence
acgucgcagccauacaucau

SEQ ID NO: 3978 - RNA, 20 nt, Artificial Sequence
  Antisense Sequence
cacgucgcagccauacauca

SEQ ID NO: 3979 - RNA, 20 nt, Artificial Sequence
  Antisense Sequence
ccacgucgcagccauacauc

SEQ ID NO: 3980 - RNA, 20 nt, Artificial Sequence
  Antisense Sequence
guucaaggcgauguaauccu

SEQ ID NO: 3981 - RNA, 20 nt, Artificial Sequence
  Antisense Sequence
cguucaaggcgauguaaucc

SEQ ID NO: 3982 - RNA, 20 nt, Artificial Sequence
  Antisense Sequence
ucguucaaggcgauguaauc

SEQ ID NO: 3983 - RNA, 20 nt, Artificial Sequence
  Antisense Sequence
cucguucaaggcgauguaau

SEQ ID NO: 3984 - RNA, 20 nt, Artificial Sequence
  Antisense Sequence
ccucguucaaggcgauguaa

SEQ ID NO: 3985 - RNA, 20 nt, Artificial Sequence
  Antisense Sequence
uccucguucaaggcgaugua

SEQ ID NO: 3986 - RNA, 20 nt, Artificial Sequence
  Antisense Sequence
guccucguucaaggcgaugu

SEQ ID NO: 3987 - RNA, 20 nt, Artificial Sequence
  Antisense Sequence
gguccucguucaaggcgaug

SEQ ID NO: 3988 - RNA, 20 nt, Artificial Sequence
  Antisense Sequence
agguccucguucaaggcgau

SEQ ID NO: 3989 - RNA, 20 nt, Artificial Sequence
  Antisense Sequence
cagguccucguucaaggcga

SEQ ID NO: 3990 - RNA, 20 nt, Artificial Sequence
  Antisense Sequence
ccacuugcgcugggugaucu

SEQ ID NO: 3991 - RNA, 20 nt, Artificial Sequence
  Antisense Sequence
ucucaacugcuccgccacac

SEQ ID NO: 3992 - RNA, 20 nt, Artificial Sequence
  Antisense Sequence
cucucaacugcuccgccaca

SEQ ID NO: 3993 - RNA, 20 nt, Artificial Sequence
  Antisense Sequence
uaggcucucaacugcuccgc

SEQ ID NO: 3994 - RNA, 20 nt, Artificial Sequence
  Antisense Sequence
guaggcucucaacugcuccg

SEQ ID NO: 3995 - RNA, 20 nt, Artificial Sequence
  Antisense Sequence
gguaggcucucaacugcucc

SEQ ID NO: 3996 - RNA, 20 nt, Artificial Sequence
  Antisense Sequence
agguaggcucucaacugcuc

SEQ ID NO: 3997 - RNA, 20 nt, Artificial Sequence
  Antisense Sequence
cagguaggcucucaacugcu

SEQ ID NO: 3998 - RNA, 20 nt, Artificial Sequence
  Antisense Sequence
uccagguaggcucucaacug

SEQ ID NO: 3999 - RNA, 20 nt, Artificial Sequence
  Antisense Sequence
gacagcguggugagucauau

SEQ ID NO: 4000 - RNA, 20 nt, Artificial Sequence
  Antisense Sequence
agacagcguggugagucaua

SEQ ID NO: 4001 - RNA, 20 nt, Artificial Sequence
  Antisense Sequence
gagacagcguggugagucau

SEQ ID NO: 4002 - RNA, 20 nt, Artificial Sequence
  Antisense Sequence
agagacagcguggugaguca

SEQ ID NO: 4003 - RNA, 20 nt, Artificial Sequence
  Antisense Sequence
cagagacagcguggugaguc

SEQ ID NO: 4004 - RNA, 20 nt, Artificial Sequence
  Antisense Sequence
ucagagacagcguggugagu

SEQ ID NO: 4005 - RNA, 20 nt, Artificial Sequence
  Antisense Sequence
gucagagacagcguggugag

SEQ ID NO: 4006 - RNA, 20 nt, Artificial Sequence
  Antisense Sequence
ggucagagacagcgugguga

SEQ ID NO: 4007 - RNA, 20 nt, Artificial Sequence
  Antisense Sequence
uggucagagacagcguggug

SEQ ID NO: 4008 - RNA, 20 nt, Artificial Sequence
  Antisense Sequence
auggucagagacagcguggu

SEQ ID NO: 4009 - RNA, 20 nt, Artificial Sequence
  Antisense Sequence
cauggucagagacagcgugg

SEQ ID NO: 4010 - RNA, 20 nt, Artificial Sequence
  Antisense Sequence
ucauggucagagacagcgug

SEQ ID NO: 4011 - RNA, 20 nt, Artificial Sequence
  Antisense Sequence
cucauggucagagacagcgu

SEQ ID NO: 4012 - RNA, 20 nt, Artificial Sequence
  Antisense Sequence
ccucauggucagagacagcg

SEQ ID NO: 4013 - RNA, 20 nt, Artificial Sequence
  Antisense Sequence
gccucauggucagagacagc

SEQ ID NO: 4014 - RNA, 20 nt, Artificial Sequence
  Antisense Sequence
uccgcaggguagaagcucag

SEQ ID NO: 4015 - RNA, 20 nt, Artificial Sequence
  Antisense Sequence
cuccgcaggguagaagcuca

SEQ ID NO: 4016 - RNA, 20 nt, Artificial Sequence
  Antisense Sequence
ucuccgcaggguagaagcuc

SEQ ID NO: 4017 - RNA, 20 nt, Artificial Sequence
  Antisense Sequence
aucuccgcaggguagaagcu

SEQ ID NO: 4018 - RNA, 20 nt, Artificial Sequence
  Antisense Sequence
uccacaagcuccguguccug

SEQ ID NO: 4019 - RNA, 20 nt, Artificial Sequence
  Antisense Sequence
cuccacaagcuccguguccu

SEQ ID NO: 4020 - RNA, 20 nt, Artificial Sequence
  Antisense Sequence
ucuccacaagcuccgugucc

SEQ ID NO: 4021 - RNA, 20 nt, Artificial Sequence
  Antisense Sequence
gucuccacaagcuccguguc

SEQ ID NO: 4022 - RNA, 20 nt, Artificial Sequence
  Antisense Sequence
ggucuccacaagcuccgugu

SEQ ID NO: 4023 - RNA, 20 nt, Artificial Sequence
  Antisense Sequence
cuggucuccacaagcuccgu

SEQ ID NO: 4024 - RNA, 20 nt, Artificial Sequence
  Antisense Sequence
caccacagacgcccacuucu

SEQ ID NO: 4025 - RNA, 20 nt, Artificial Sequence
  Antisense Sequence
accaccacagacgcccacuu

SEQ ID NO: 4026 - RNA, 20 nt, Artificial Sequence
  Antisense Sequence
agaaggcaccaccacagacg

SEQ ID NO: 4027 - RNA, 20 nt, Artificial Sequence
  Antisense Sequence
uccuguccagaaggcaccac

SEQ ID NO: 4028 - RNA, 20 nt, Artificial Sequence
  Antisense Sequence
cuccuguccagaaggcacca

SEQ ID NO: 4029 - RNA, 20 nt, Artificial Sequence
  Antisense Sequence
ugcuccuguccagaaggcac

SEQ ID NO: 4030 - RNA, 20 nt, Artificial Sequence
  Antisense Sequence
cugcuccuguccagaaggca

SEQ ID NO: 4031 - RNA, 20 nt, Artificial Sequence
  Antisense Sequence
guaucucugcuccuguccag

SEQ ID NO: 4032 - RNA, 20 nt, Artificial Sequence
  Antisense Sequence
guguaucucugcuccugucc

SEQ ID NO: 4033 - RNA, 20 nt, Artificial Sequence
  Antisense Sequence
aagacggcucccaucucagg

SEQ ID NO: 4034 - RNA, 20 nt, Artificial Sequence
  Antisense Sequence
gaagacggcucccaucucag

SEQ ID NO: 4035 - RNA, 20 nt, Artificial Sequence
  Antisense Sequence
ggaagacggcucccaucuca

SEQ ID NO: 4036 - RNA, 20 nt, Artificial Sequence
  Antisense Sequence
uaggccagcaaugaugccca

SEQ ID NO: 4037 - RNA, 20 nt, Artificial Sequence
  Antisense Sequence
acuaggccagcaaugaugcc

SEQ ID NO: 4038 - RNA, 20 nt, Artificial Sequence
  Antisense Sequence
aacuaggccagcaaugaugc

SEQ ID NO: 4039 - RNA, 20 nt, Artificial Sequence
  Antisense Sequence
gaacuaggccagcaaugaug

SEQ ID NO: 4040 - RNA, 20 nt, Artificial Sequence
  Antisense Sequence
gagaacuaggccagcaauga

SEQ ID NO: 4041 - RNA, 20 nt, Artificial Sequence
  Antisense Sequence
agagaacuaggccagcaaug

SEQ ID NO: 4042 - RNA, 20 nt, Artificial Sequence
  Antisense Sequence
aagagaacuaggccagcaau

SEQ ID NO: 4043 - RNA, 20 nt, Artificial Sequence
  Antisense Sequence
aaagagaacuaggccagcaa

SEQ ID NO: 4044 - RNA, 20 nt, Artificial Sequence
  Antisense Sequence
caaagagaacuaggccagca

SEQ ID NO: 4045 - RNA, 20 nt, Artificial Sequence
  Antisense Sequence
ccaaagagaacuaggccagc

SEQ ID NO: 4046 - RNA, 20 nt, Artificial Sequence
  Antisense Sequence
uccaaagagaacuaggccag

SEQ ID NO: 4047 - RNA, 20 nt, Artificial Sequence
  Antisense Sequence
cuccaaagagaacuaggcca

SEQ ID NO: 4048 - RNA, 20 nt, Artificial Sequence
  Antisense Sequence
gcuccaaagagaacuaggcc

SEQ ID NO: 4049 - RNA, 20 nt, Artificial Sequence
  Antisense Sequence
agcuccaaagagaacuaggc

SEQ ID NO: 4050 - RNA, 20 nt, Artificial Sequence
  Antisense Sequence
cagcuccaaagagaacuagg

SEQ ID NO: 4051 - RNA, 20 nt, Artificial Sequence
  Antisense Sequence
acagcuccaaagagaacuag

SEQ ID NO: 4052 - RNA, 20 nt, Artificial Sequence
  Antisense Sequence
aacacagcuccaaagagaac

SEQ ID NO: 4053 - RNA, 20 nt, Artificial Sequence
  Antisense Sequence
cgaacacagcuccaaagaga

SEQ ID NO: 4054 - RNA, 20 nt, Artificial Sequence
  Antisense Sequence
gcgaacacagcuccaaagag

SEQ ID NO: 4055 - RNA, 20 nt, Artificial Sequence
  Antisense Sequence
agcgaacacagcuccaaaga

SEQ ID NO: 4056 - RNA, 20 nt, Artificial Sequence
  Antisense Sequence
cagcgaacacagcuccaaag

SEQ ID NO: 4057 - RNA, 20 nt, Artificial Sequence
  Antisense Sequence
ccagcgaacacagcuccaaa

SEQ ID NO: 4058 - RNA, 20 nt, Artificial Sequence
  Antisense Sequence
uccagcgaacacagcuccaa

SEQ ID NO: 4059 - RNA, 20 nt, Artificial Sequence
  Antisense Sequence
cuccagcgaacacagcucca

SEQ ID NO: 4060 - RNA, 20 nt, Artificial Sequence
  Antisense Sequence
acagcuccagcgaacacagc

SEQ ID NO: 4061 - RNA, 20 nt, Artificial Sequence
  Antisense Sequence
cacagcuccagcgaacacag

SEQ ID NO: 4062 - RNA, 20 nt, Artificial Sequence
  Antisense Sequence
ccacagcuccagcgaacaca

SEQ ID NO: 4063 - RNA, 20 nt, Artificial Sequence
  Antisense Sequence
accacagcuccagcgaacac

SEQ ID NO: 4064 - RNA, 20 nt, Artificial Sequence
  Antisense Sequence
gaccacagcuccagcgaaca

SEQ ID NO: 4065 - RNA, 20 nt, Artificial Sequence
  Antisense Sequence
accucacagcagcgaccaca

SEQ ID NO: 4066 - RNA, 20 nt, Artificial Sequence
  Antisense Sequence
cccuccuuuucuaucugagc

SEQ ID NO: 4067 - RNA, 20 nt, Artificial Sequence
  Antisense Sequence
acugcuugcagccugagagu

SEQ ID NO: 4068 - RNA, 20 nt, Artificial Sequence
  Antisense Sequence
cacugcuugcagccugagag

SEQ ID NO: 4069 - RNA, 20 nt, Artificial Sequence
  Antisense Sequence
ucacugcuugcagccugaga

SEQ ID NO: 4070 - RNA, 20 nt, Artificial Sequence
  Antisense Sequence
gucacugcuugcagccugag

SEQ ID NO: 4071 - RNA, 20 nt, Artificial Sequence
  Antisense Sequence
ugucacugcuugcagccuga

SEQ ID NO: 4072 - RNA, 20 nt, Artificial Sequence
  Antisense Sequence
cugucacugcuugcagccug

SEQ ID NO: 4073 - RNA, 20 nt, Artificial Sequence
  Antisense Sequence
acugucacugcuugcagccu

SEQ ID NO: 4074 - RNA, 20 nt, Artificial Sequence
  Antisense Sequence
cacugucacugcuugcagcc

SEQ ID NO: 4075 - RNA, 20 nt, Artificial Sequence
  Antisense Sequence
gcacugucacugcuugcagc

SEQ ID NO: 4076 - RNA, 20 nt, Artificial Sequence
  Antisense Sequence
ggcacugucacugcuugcag

SEQ ID NO: 4077 - RNA, 20 nt, Artificial Sequence
  Antisense Sequence
gggcacugucacugcuugca

SEQ ID NO: 4078 - RNA, 20 nt, Artificial Sequence
  Antisense Sequence
ugggcacugucacugcuugc

SEQ ID NO: 4079 - RNA, 20 nt, Artificial Sequence
  Antisense Sequence
auaucagagcccugggcacu

SEQ ID NO: 4080 - RNA, 20 nt, Artificial Sequence
  Antisense Sequence
cauaucagagcccugggcac

SEQ ID NO: 4081 - RNA, 20 nt, Artificial Sequence
  Antisense Sequence
acauaucagagcccugggca

SEQ ID NO: 4082 - RNA, 20 nt, Artificial Sequence
  Antisense Sequence
gacauaucagagcccugggc

SEQ ID NO: 4083 - RNA, 20 nt, Artificial Sequence
  Antisense Sequence
agacauaucagagcccuggg

SEQ ID NO: 4084 - RNA, 20 nt, Artificial Sequence
  Antisense Sequence
gagacauaucagagcccugg

SEQ ID NO: 4085 - RNA, 20 nt, Artificial Sequence
  Antisense Sequence
agagacauaucagagcccug

SEQ ID NO: 4086 - RNA, 20 nt, Artificial Sequence
  Antisense Sequence
gagagacauaucagagcccu

SEQ ID NO: 4087 - RNA, 20 nt, Artificial Sequence
  Antisense Sequence
ugagagacauaucagagccc

SEQ ID NO: 4088 - RNA, 20 nt, Artificial Sequence
  Antisense Sequence
gugagagacauaucagagcc

SEQ ID NO: 4089 - RNA, 20 nt, Artificial Sequence
  Antisense Sequence
ugugagagacauaucagagc

SEQ ID NO: 4090 - RNA, 20 nt, Artificial Sequence
  Antisense Sequence
cugugagagacauaucagag

SEQ ID NO: 4091 - RNA, 20 nt, Artificial Sequence
  Antisense Sequence
gcugugagagacauaucaga

SEQ ID NO: 4092 - RNA, 20 nt, Artificial Sequence
  Antisense Sequence
agcugugagagacauaucag

SEQ ID NO: 4093 - RNA, 20 nt, Artificial Sequence
  Antisense Sequence
aagcugugagagacauauca

SEQ ID NO: 4094 - RNA, 20 nt, Artificial Sequence
  Antisense Sequence
caagcugugagagacauauc

SEQ ID NO: 4095 - RNA, 20 nt, Artificial Sequence
  Antisense Sequence
acaagcugugagagacauau

SEQ ID NO: 4096 - RNA, 20 nt, Artificial Sequence
  Antisense Sequence
uacaagcugugagagacaua

SEQ ID NO: 4097 - RNA, 20 nt, Artificial Sequence
  Antisense Sequence
cuuuacaagcugugagagac

SEQ ID NO: 4098 - RNA, 20 nt, Artificial Sequence
  Antisense Sequence
acuuuacaagcugugagaga

SEQ ID NO: 4099 - RNA, 20 nt, Artificial Sequence
  Antisense Sequence
cacuuuacaagcugugagag

SEQ ID NO: 4100 - RNA, 20 nt, Artificial Sequence
  Antisense Sequence
acacuuuacaagcugugaga

SEQ ID NO: 4101 - RNA, 20 nt, Artificial Sequence
  Antisense Sequence
ucucacacuuuacaagcugu

SEQ ID NO: 4102 - RNA, 20 nt, Artificial Sequence
  Antisense Sequence
gucucacacuuuacaagcug

SEQ ID NO: 4103 - RNA, 20 nt, Artificial Sequence
  Antisense Sequence
ugucucacacuuuacaagcu

SEQ ID NO: 4104 - RNA, 20 nt, Artificial Sequence
  Antisense Sequence
cugucucacacuuuacaagc

SEQ ID NO: 4105 - RNA, 20 nt, Artificial Sequence
  Antisense Sequence
gcugucucacacuuuacaag

SEQ ID NO: 4106 - RNA, 20 nt, Artificial Sequence
  Antisense Sequence
agcugucucacacuuuacaa

SEQ ID NO: 4107 - RNA, 20 nt, Artificial Sequence
  Antisense Sequence
gcaggaacaaaucuugccuc

SEQ ID NO: 4108 - RNA, 20 nt, Artificial Sequence
  Antisense Sequence
gaagggcaggaacaaaucuu

SEQ ID NO: 4109 - RNA, 20 nt, Artificial Sequence
  Antisense Sequence
ggaagggcaggaacaaaucu

SEQ ID NO: 4110 - RNA, 20 nt, Artificial Sequence
  Antisense Sequence
ucaagucacaaagggaaggg

SEQ ID NO: 4111 - RNA, 20 nt, Artificial Sequence
  Antisense Sequence
aacaaagucaggguucuuca

SEQ ID NO: 4112 - RNA, 20 nt, Artificial Sequence
  Antisense Sequence
aaacaaagucaggguucuuc

SEQ ID NO: 4113 - RNA, 20 nt, Artificial Sequence
  Antisense Sequence
cagaaacaaagucaggguuc

SEQ ID NO: 4114 - RNA, 20 nt, Artificial Sequence
  Antisense Sequence
ugcagaaacaaagucagggu

SEQ ID NO: 4115 - RNA, 20 nt, Artificial Sequence
  Antisense Sequence
gcaggugccuuugcagaaac

SEQ ID NO: 4116 - RNA, 20 nt, Artificial Sequence
  Antisense Sequence
acacagacacaugcaggugc

SEQ ID NO: 4117 - RNA, 20 nt, Artificial Sequence
  Antisense Sequence
aacacagacacaugcaggug

SEQ ID NO: 4118 - RNA, 20 nt, Artificial Sequence
  Antisense Sequence
uacaagaacacagacacaug

SEQ ID NO: 4119 - RNA, 20 nt, Artificial Sequence
  Antisense Sequence
ccuacaagaacacagacaca

SEQ ID NO: 4120 - RNA, 20 nt, Artificial Sequence
  Antisense Sequence
ugccuacaagaacacagaca

SEQ ID NO: 4121 - RNA, 20 nt, Artificial Sequence
  Antisense Sequence
augccuacaagaacacagac

SEQ ID NO: 4122 - RNA, 20 nt, Artificial Sequence
  Antisense Sequence
uaugccuacaagaacacaga

SEQ ID NO: 4123 - RNA, 20 nt, Artificial Sequence
  Antisense Sequence
uuaugccuacaagaacacag

SEQ ID NO: 4124 - RNA, 20 nt, Artificial Sequence
  Antisense Sequence
cauuaugccuacaagaacac

SEQ ID NO: 4125 - RNA, 20 nt, Artificial Sequence
  Antisense Sequence
cacauuaugccuacaagaac

SEQ ID NO: 4126 - RNA, 20 nt, Artificial Sequence
  Antisense Sequence
cucacauuaugccuacaaga

SEQ ID NO: 4127 - RNA, 20 nt, Artificial Sequence
  Antisense Sequence
ccucacauuaugccuacaag

SEQ ID NO: 4128 - RNA, 20 nt, Artificial Sequence
  Antisense Sequence
uccucacauuaugccuacaa

SEQ ID NO: 4129 - RNA, 20 nt, Artificial Sequence
  Antisense Sequence
cuccucacauuaugccuaca

SEQ ID NO: 4130 - RNA, 20 nt, Artificial Sequence
  Antisense Sequence
agcgugggaagagggucaug

SEQ ID NO: 4131 - RNA, 20 nt, Artificial Sequence
  Antisense Sequence
cagcgugggaagagggucau

SEQ ID NO: 4132 - RNA, 20 nt, Artificial Sequence
  Antisense Sequence
ucagcgugggaagaggguca

SEQ ID NO: 4133 - RNA, 20 nt, Artificial Sequence
  Antisense Sequence
acaggucagcgugggaagag

SEQ ID NO: 4134 - RNA, 20 nt, Artificial Sequence
  Antisense Sequence
cacaggucagcgugggaaga

SEQ ID NO: 4135 - RNA, 20 nt, Artificial Sequence
  Antisense Sequence
agcacaggucagcgugggaa

SEQ ID NO: 4136 - RNA, 20 nt, Artificial Sequence
  Antisense Sequence
gcagagauggagacaccuca

SEQ ID NO: 4137 - RNA, 20 nt, Artificial Sequence
  Antisense Sequence
gaaguugaggcagagaugga

SEQ ID NO: 4138 - RNA, 20 nt, Artificial Sequence
  Antisense Sequence
ugaaguugaggcagagaugg

SEQ ID NO: 4139 - RNA, 20 nt, Artificial Sequence
  Antisense Sequence
augaaguugaggcagagaug

SEQ ID NO: 4140 - RNA, 20 nt, Artificial Sequence
  Antisense Sequence
ccaugaaguugaggcagaga

SEQ ID NO: 4141 - RNA, 20 nt, Artificial Sequence
  Antisense Sequence
accaugaaguugaggcagag

SEQ ID NO: 4142 - RNA, 20 nt, Artificial Sequence
  Antisense Sequence
gcaccaugaaguugaggcag

SEQ ID NO: 4143 - RNA, 20 nt, Artificial Sequence
  Antisense Sequence
ugcaccaugaaguugaggca

SEQ ID NO: 4144 - RNA, 20 nt, Artificial Sequence
  Antisense Sequence
ggaaggaagaaguuacagcu

SEQ ID NO: 4145 - RNA, 20 nt, Artificial Sequence
  Antisense Sequence
gggaaggaagaaguuacagc

SEQ ID NO: 4146 - RNA, 19 nt, Artificial Sequence
  siRNA Sense Sequence
cccgaaggcgguguaugga

SEQ ID NO: 4147 - RNA, 19 nt, Artificial Sequence
  siRNA Antisense Sequence
uccauacaccgccuucggg

SEQ ID NO: 4148 - RNA, 19 nt, Artificial Sequence
  siRNA Sense Sequence
ccgaaggcgguguauggau

SEQ ID NO: 4149 - RNA, 19 nt, Artificial Sequence
  siRNA Antisense Sequence
auccauacaccgccuucgg

SEQ ID NO: 4150 - RNA, 19 nt, Artificial Sequence
  siRNA Sense Sequence
acuccgcaguuucuuuucu

SEQ ID NO: 4151 - RNA, 19 nt, Artificial Sequence
  siRNA Antisense Sequence
agaaaagaaacugcggagu

SEQ ID NO: 4152 - RNA, 19 nt, Artificial Sequence
  siRNA Sense Sequence
gcaguuucuuuucucccuc

SEQ ID NO: 4153 - RNA, 19 nt, Artificial Sequence
  siRNA Antisense Sequence
gagggagaaaagaaacugc

SEQ ID NO: 4154 - RNA, 19 nt, Artificial Sequence
  siRNA Sense Sequence
aguuucuuuucucccucug

SEQ ID NO: 4155 - RNA, 19 nt, Artificial Sequence
  siRNA Antisense Sequence
cagagggagaaaagaaacu

SEQ ID NO: 4156 - RNA, 19 nt, Artificial Sequence
  siRNA Sense Sequence
ucucccucugccaaccuau

SEQ ID NO: 4157 - RNA, 19 nt, Artificial Sequence
  siRNA Antisense Sequence
auagguuggcagagggaga

SEQ ID NO: 4158 - RNA, 19 nt, Artificial Sequence
  siRNA Sense Sequence
cucccucugccaaccuaug

SEQ ID NO: 4159 - RNA, 19 nt, Artificial Sequence
  siRNA Antisense Sequence
cauagguuggcagagggag

SEQ ID NO: 4160 - RNA, 19 nt, Artificial Sequence
  siRNA Sense Sequence
cucugccaaccuauguagg

SEQ ID NO: 4161 - RNA, 19 nt, Artificial Sequence
  siRNA Antisense Sequence
ccuacauagguuggcagag

SEQ ID NO: 4162 - RNA, 19 nt, Artificial Sequence
  siRNA Sense Sequence
ucugccaaccuauguaggg

SEQ ID NO: 4163 - RNA, 19 nt, Artificial Sequence
  siRNA Antisense Sequence
cccuacauagguuggcaga

SEQ ID NO: 4164 - RNA, 19 nt, Artificial Sequence
  siRNA Sense Sequence
cugccaaccuauguagggu

SEQ ID NO: 4165 - RNA, 19 nt, Artificial Sequence
  siRNA Antisense Sequence
acccuacauagguuggcag

SEQ ID NO: 4166 - RNA, 19 nt, Artificial Sequence
  siRNA Sense Sequence
aaccuauguaggguccuuc

SEQ ID NO: 4167 - RNA, 19 nt, Artificial Sequence
  siRNA Antisense Sequence
gaaggacccuacauagguu

SEQ ID NO: 4168 - RNA, 19 nt, Artificial Sequence
  siRNA Sense Sequence
accuauguaggguccuucu

SEQ ID NO: 4169 - RNA, 19 nt, Artificial Sequence
  siRNA Antisense Sequence
agaaggacccuacauaggu

SEQ ID NO: 4170 - RNA, 19 nt, Artificial Sequence
  siRNA Sense Sequence
ccuauguaggguccuucuu

SEQ ID NO: 4171 - RNA, 19 nt, Artificial Sequence
  siRNA Antisense Sequence
aagaaggacccuacauagg

SEQ ID NO: 4172 - RNA, 19 nt, Artificial Sequence
  siRNA Sense Sequence
cuauguaggguccuucuuc

SEQ ID NO: 4173 - RNA, 19 nt, Artificial Sequence
  siRNA Antisense Sequence
gaagaaggacccuacauag

SEQ ID NO: 4174 - RNA, 19 nt, Artificial Sequence
  siRNA Sense Sequence
uucuuccuggauacucacg

SEQ ID NO: 4175 - RNA, 19 nt, Artificial Sequence
  siRNA Antisense Sequence
cgugaguauccaggaagaa

SEQ ID NO: 4176 - RNA, 19 nt, Artificial Sequence
  siRNA Sense Sequence
ucuuccuggauacucacga

SEQ ID NO: 4177 - RNA, 19 nt, Artificial Sequence
  siRNA Antisense Sequence
ucgugaguauccaggaaga

SEQ ID NO: 4178 - RNA, 19 nt, Artificial Sequence
  siRNA Sense Sequence
cuuccuggauacucacgac

SEQ ID NO: 4179 - RNA, 19 nt, Artificial Sequence
  siRNA Antisense Sequence
gucgugaguauccaggaag

SEQ ID NO: 4180 - RNA, 19 nt, Artificial Sequence
  siRNA Sense Sequence
uuccuggauacucacgacg

SEQ ID NO: 4181 - RNA, 19 nt, Artificial Sequence
  siRNA Antisense Sequence
cgucgugaguauccaggaa

SEQ ID NO: 4182 - RNA, 19 nt, Artificial Sequence
  siRNA Sense Sequence
uccuggauacucacgacgc

SEQ ID NO: 4183 - RNA, 19 nt, Artificial Sequence
  siRNA Antisense Sequence
gcgucgugaguauccagga

SEQ ID NO: 4184 - RNA, 19 nt, Artificial Sequence
  siRNA Sense Sequence
ccuggauacucacgacgcg

SEQ ID NO: 4185 - RNA, 19 nt, Artificial Sequence
  siRNA Antisense Sequence
cgcgucgugaguauccagg

SEQ ID NO: 4186 - RNA, 19 nt, Artificial Sequence
  siRNA Sense Sequence
cuggauacucacgacgcgg

SEQ ID NO: 4187 - RNA, 19 nt, Artificial Sequence
  siRNA Antisense Sequence
ccgcgucgugaguauccag

SEQ ID NO: 4188 - RNA, 19 nt, Artificial Sequence
  siRNA Sense Sequence
uggauacucacgacgcgga

SEQ ID NO: 4189 - RNA, 19 nt, Artificial Sequence
  siRNA Antisense Sequence
uccgcgucgugaguaucca

SEQ ID NO: 4190 - RNA, 19 nt, Artificial Sequence
  siRNA Sense Sequence
ggauacucacgacgcggac

SEQ ID NO: 4191 - RNA, 19 nt, Artificial Sequence
  siRNA Antisense Sequence
guccgcgucgugaguaucc

SEQ ID NO: 4192 - RNA, 19 nt, Artificial Sequence
  siRNA Sense Sequence
gauacucacgacgcggacc

SEQ ID NO: 4193 - RNA, 19 nt, Artificial Sequence
  siRNA Antisense Sequence
gguccgcgucgugaguauc

SEQ ID NO: 4194 - RNA, 19 nt, Artificial Sequence
  siRNA Sense Sequence
auacucacgacgcggaccc

SEQ ID NO: 4195 - RNA, 19 nt, Artificial Sequence
  siRNA Antisense Sequence
ggguccgcgucgugaguau

SEQ ID NO: 4196 - RNA, 19 nt, Artificial Sequence
  siRNA Sense Sequence
uacucacgacgcggaccca

SEQ ID NO: 4197 - RNA, 19 nt, Artificial Sequence
  siRNA Antisense Sequence
uggguccgcgucgugagua

SEQ ID NO: 4198 - RNA, 19 nt, Artificial Sequence
  siRNA Sense Sequence
caguucucacucccauugg

SEQ ID NO: 4199 - RNA, 19 nt, Artificial Sequence
  siRNA Antisense Sequence
ccaaugggagugagaacug

SEQ ID NO: 4200 - RNA, 19 nt, Artificial Sequence
  siRNA Sense Sequence
guucucacucccauugggu

SEQ ID NO: 4201 - RNA, 19 nt, Artificial Sequence
  siRNA Antisense Sequence
acccaaugggagugagaac

SEQ ID NO: 4202 - RNA, 19 nt, Artificial Sequence
  siRNA Sense Sequence
ucucacucccauugggugu

SEQ ID NO: 4203 - RNA, 19 nt, Artificial Sequence
  siRNA Antisense Sequence
acacccaaugggagugaga

SEQ ID NO: 4204 - RNA, 19 nt, Artificial Sequence
  siRNA Sense Sequence
cucacucccauuggguguc

SEQ ID NO: 4205 - RNA, 19 nt, Artificial Sequence
  siRNA Antisense Sequence
gacacccaaugggagugag

SEQ ID NO: 4206 - RNA, 19 nt, Artificial Sequence
  siRNA Sense Sequence
ucacucccauugggugucg

SEQ ID NO: 4207 - RNA, 19 nt, Artificial Sequence
  siRNA Antisense Sequence
cgacacccaaugggaguga

SEQ ID NO: 4208 - RNA, 19 nt, Artificial Sequence
  siRNA Sense Sequence
ucccauugggugucggguu

SEQ ID NO: 4209 - RNA, 19 nt, Artificial Sequence
  siRNA Antisense Sequence
aacccgacacccaauggga

SEQ ID NO: 4210 - RNA, 19 nt, Artificial Sequence
  siRNA Sense Sequence
cccauugggugucggguuu

SEQ ID NO: 4211 - RNA, 19 nt, Artificial Sequence
  siRNA Antisense Sequence
aaacccgacacccaauggg

SEQ ID NO: 4212 - RNA, 19 nt, Artificial Sequence
  siRNA Sense Sequence
ccauugggugucggguuuc

SEQ ID NO: 4213 - RNA, 19 nt, Artificial Sequence
  siRNA Antisense Sequence
gaaacccgacacccaaugg

SEQ ID NO: 4214 - RNA, 19 nt, Artificial Sequence
  siRNA Sense Sequence
cauugggugucggguuucc

SEQ ID NO: 4215 - RNA, 19 nt, Artificial Sequence
  siRNA Antisense Sequence
ggaaacccgacacccaaug

SEQ ID NO: 4216 - RNA, 19 nt, Artificial Sequence
  siRNA Sense Sequence
auugggugucggguuucca

SEQ ID NO: 4217 - RNA, 19 nt, Artificial Sequence
  siRNA Antisense Sequence
uggaaacccgacacccaau

SEQ ID NO: 4218 - RNA, 19 nt, Artificial Sequence
  siRNA Sense Sequence
uugggugucggguuuccag

SEQ ID NO: 4219 - RNA, 19 nt, Artificial Sequence
  siRNA Antisense Sequence
cuggaaacccgacacccaa

SEQ ID NO: 4220 - RNA, 19 nt, Artificial Sequence
  siRNA Sense Sequence
ugggugucggguuuccaga

SEQ ID NO: 4221 - RNA, 19 nt, Artificial Sequence
  siRNA Antisense Sequence
ucuggaaacccgacaccca

SEQ ID NO: 4222 - RNA, 19 nt, Artificial Sequence
  siRNA Sense Sequence
agaagccaaucagugucgu

SEQ ID NO: 4223 - RNA, 19 nt, Artificial Sequence
  siRNA Antisense Sequence
acgacacugauuggcuucu

SEQ ID NO: 4224 - RNA, 19 nt, Artificial Sequence
  siRNA Sense Sequence
gaagccaaucagugucguc

SEQ ID NO: 4225 - RNA, 19 nt, Artificial Sequence
  siRNA Antisense Sequence
gacgacacugauuggcuuc

SEQ ID NO: 4226 - RNA, 19 nt, Artificial Sequence
  siRNA Sense Sequence
ccaaucagugucgucgcgg

SEQ ID NO: 4227 - RNA, 19 nt, Artificial Sequence
  siRNA Antisense Sequence
ccgcgacgacacugauugg

SEQ ID NO: 4228 - RNA, 19 nt, Artificial Sequence
  siRNA Sense Sequence
caaucagugucgucgcggu

SEQ ID NO: 4229 - RNA, 19 nt, Artificial Sequence
  siRNA Antisense Sequence
accgcgacgacacugauug

SEQ ID NO: 4230 - RNA, 19 nt, Artificial Sequence
  siRNA Sense Sequence
aaucagugucgucgcgguc

SEQ ID NO: 4231 - RNA, 19 nt, Artificial Sequence
  siRNA Antisense Sequence
gaccgcgacgacacugauu

SEQ ID NO: 4232 - RNA, 19 nt, Artificial Sequence
  siRNA Sense Sequence
aucagugucgucgcggucg

SEQ ID NO: 4233 - RNA, 19 nt, Artificial Sequence
  siRNA Antisense Sequence
cgaccgcgacgacacugau

SEQ ID NO: 4234 - RNA, 19 nt, Artificial Sequence
  siRNA Sense Sequence
gucgcggucgcgguucuaa

SEQ ID NO: 4235 - RNA, 19 nt, Artificial Sequence
  siRNA Antisense Sequence
uuagaaccgcgaccgcgac

SEQ ID NO: 4236 - RNA, 19 nt, Artificial Sequence
  siRNA Sense Sequence
ucgcggucgcgguucuaaa

SEQ ID NO: 4237 - RNA, 19 nt, Artificial Sequence
  siRNA Antisense Sequence
uuuagaaccgcgaccgcga

SEQ ID NO: 4238 - RNA, 19 nt, Artificial Sequence
  siRNA Sense Sequence
cgcggucgcgguucuaaag

SEQ ID NO: 4239 - RNA, 19 nt, Artificial Sequence
  siRNA Antisense Sequence
cuuuagaaccgcgaccgcg

SEQ ID NO: 4240 - RNA, 19 nt, Artificial Sequence
  siRNA Sense Sequence
gcggucgcgguucuaaagu

SEQ ID NO: 4241 - RNA, 19 nt, Artificial Sequence
  siRNA Antisense Sequence
acuuuagaaccgcgaccgc

SEQ ID NO: 4242 - RNA, 19 nt, Artificial Sequence
  siRNA Sense Sequence
cggucgcgguucuaaaguc

SEQ ID NO: 4243 - RNA, 19 nt, Artificial Sequence
  siRNA Antisense Sequence
gacuuuagaaccgcgaccg

SEQ ID NO: 4244 - RNA, 19 nt, Artificial Sequence
  siRNA Sense Sequence
ggucgcgguucuaaagucc

SEQ ID NO: 4245 - RNA, 19 nt, Artificial Sequence
  siRNA Antisense Sequence
ggacuuuagaaccgcgacc

SEQ ID NO: 4246 - RNA, 19 nt, Artificial Sequence
  siRNA Sense Sequence
gucgcgguucuaaaguccg

SEQ ID NO: 4247 - RNA, 19 nt, Artificial Sequence
  siRNA Antisense Sequence
cggacuuuagaaccgcgac

SEQ ID NO: 4248 - RNA, 19 nt, Artificial Sequence
  siRNA Sense Sequence
cgguucuaaaguccgcacg

SEQ ID NO: 4249 - RNA, 19 nt, Artificial Sequence
  siRNA Antisense Sequence
cgugcggacuuuagaaccg

SEQ ID NO: 4250 - RNA, 19 nt, Artificial Sequence
  siRNA Sense Sequence
gguucuaaaguccgcacgc

SEQ ID NO: 4251 - RNA, 19 nt, Artificial Sequence
  siRNA Antisense Sequence
gcgugcggacuuuagaacc

SEQ ID NO: 4252 - RNA, 19 nt, Artificial Sequence
  siRNA Sense Sequence
guucuaaaguccgcacgca

SEQ ID NO: 4253 - RNA, 19 nt, Artificial Sequence
  siRNA Antisense Sequence
ugcgugcggacuuuagaac

SEQ ID NO: 4254 - RNA, 19 nt, Artificial Sequence
  siRNA Sense Sequence
uucuaaaguccgcacgcac

SEQ ID NO: 4255 - RNA, 19 nt, Artificial Sequence
  siRNA Antisense Sequence
gugcgugcggacuuuagaa

SEQ ID NO: 4256 - RNA, 19 nt, Artificial Sequence
  siRNA Sense Sequence
aaaguccgcacgcacccac

SEQ ID NO: 4257 - RNA, 19 nt, Artificial Sequence
  siRNA Antisense Sequence
gugggugcgugcggacuuu

SEQ ID NO: 4258 - RNA, 19 nt, Artificial Sequence
  siRNA Sense Sequence
cccaccgggacucagauuc

SEQ ID NO: 4259 - RNA, 19 nt, Artificial Sequence
  siRNA Antisense Sequence
gaaucugagucccgguggg

SEQ ID NO: 4260 - RNA, 19 nt, Artificial Sequence
  siRNA Sense Sequence
aacccuccuccugcuacuc

SEQ ID NO: 4261 - RNA, 19 nt, Artificial Sequence
  siRNA Antisense Sequence
gaguagcaggaggaggguu

SEQ ID NO: 4262 - RNA, 19 nt, Artificial Sequence
  siRNA Sense Sequence
acccuccuccugcuacucu

SEQ ID NO: 4263 - RNA, 19 nt, Artificial Sequence
  siRNA Antisense Sequence
agaguagcaggaggagggu

SEQ ID NO: 4264 - RNA, 19 nt, Artificial Sequence
  siRNA Sense Sequence
cccuccuccugcuacucuu

SEQ ID NO: 4265 - RNA, 19 nt, Artificial Sequence
  siRNA Antisense Sequence
aagaguagcaggaggaggg

SEQ ID NO: 4266 - RNA, 19 nt, Artificial Sequence
  siRNA Sense Sequence
uccaugagguauuucacca

SEQ ID NO: 4267 - RNA, 19 nt, Artificial Sequence
  siRNA Antisense Sequence
uggugaaauaccucaugga

SEQ ID NO: 4268 - RNA, 19 nt, Artificial Sequence
  siRNA Sense Sequence
ccaugagguauuucaccac

SEQ ID NO: 4269 - RNA, 19 nt, Artificial Sequence
  siRNA Antisense Sequence
guggugaaauaccucaugg

SEQ ID NO: 4270 - RNA, 19 nt, Artificial Sequence
  siRNA Sense Sequence
caugagguauuucaccaca

SEQ ID NO: 4271 - RNA, 19 nt, Artificial Sequence
  siRNA Antisense Sequence
uguggugaaauaccucaug

SEQ ID NO: 4272 - RNA, 19 nt, Artificial Sequence
  siRNA Sense Sequence
agguauuucaccacauccg

SEQ ID NO: 4273 - RNA, 19 nt, Artificial Sequence
  siRNA Antisense Sequence
cggauguggugaaauaccu

SEQ ID NO: 4274 - RNA, 19 nt, Artificial Sequence
  siRNA Sense Sequence
gguauuucaccacauccgu

SEQ ID NO: 4275 - RNA, 19 nt, Artificial Sequence
  siRNA Antisense Sequence
acggauguggugaaauacc

SEQ ID NO: 4276 - RNA, 19 nt, Artificial Sequence
  siRNA Sense Sequence
guauuucaccacauccgug

SEQ ID NO: 4277 - RNA, 19 nt, Artificial Sequence
  siRNA Antisense Sequence
cacggauguggugaaauac

SEQ ID NO: 4278 - RNA, 19 nt, Artificial Sequence
  siRNA Sense Sequence
uauuucaccacauccgugu

SEQ ID NO: 4279 - RNA, 19 nt, Artificial Sequence
  siRNA Antisense Sequence
acacggauguggugaaaua

SEQ ID NO: 4280 - RNA, 19 nt, Artificial Sequence
  siRNA Sense Sequence
auuucaccacauccguguc

SEQ ID NO: 4281 - RNA, 19 nt, Artificial Sequence
  siRNA Antisense Sequence
gacacggauguggugaaau

SEQ ID NO: 4282 - RNA, 19 nt, Artificial Sequence
  siRNA Sense Sequence
uuucaccacauccgugucc

SEQ ID NO: 4283 - RNA, 19 nt, Artificial Sequence
  siRNA Antisense Sequence
ggacacggauguggugaaa

SEQ ID NO: 4284 - RNA, 19 nt, Artificial Sequence
  siRNA Sense Sequence
uucaccacauccguguccc

SEQ ID NO: 4285 - RNA, 19 nt, Artificial Sequence
  siRNA Antisense Sequence
gggacacggauguggugaa

SEQ ID NO: 4286 - RNA, 19 nt, Artificial Sequence
  siRNA Sense Sequence
ucaccacauccgugucccg

SEQ ID NO: 4287 - RNA, 19 nt, Artificial Sequence
  siRNA Antisense Sequence
cgggacacggaugugguga

SEQ ID NO: 4288 - RNA, 19 nt, Artificial Sequence
  siRNA Sense Sequence
gcuucaucgccgugggcua

SEQ ID NO: 4289 - RNA, 19 nt, Artificial Sequence
  siRNA Antisense Sequence
uagcccacggcgaugaagc

SEQ ID NO: 4290 - RNA, 19 nt, Artificial Sequence
  siRNA Sense Sequence
cuucaucgccgugggcuac

SEQ ID NO: 4291 - RNA, 19 nt, Artificial Sequence
  siRNA Antisense Sequence
guagcccacggcgaugaag

SEQ ID NO: 4292 - RNA, 19 nt, Artificial Sequence
  siRNA Sense Sequence
uucaucgccgugggcuacg

SEQ ID NO: 4293 - RNA, 19 nt, Artificial Sequence
  siRNA Antisense Sequence
cguagcccacggcgaugaa

SEQ ID NO: 4294 - RNA, 19 nt, Artificial Sequence
  siRNA Sense Sequence
caguucgugcgguuugaca

SEQ ID NO: 4295 - RNA, 19 nt, Artificial Sequence
  siRNA Antisense Sequence
ugucaaaccgcacgaacug

SEQ ID NO: 4296 - RNA, 19 nt, Artificial Sequence
  siRNA Sense Sequence
aguucgugcgguuugacag

SEQ ID NO: 4297 - RNA, 19 nt, Artificial Sequence
  siRNA Antisense Sequence
cugucaaaccgcacgaacu

SEQ ID NO: 4298 - RNA, 19 nt, Artificial Sequence
  siRNA Sense Sequence
guucgugcgguuugacagc

SEQ ID NO: 4299 - RNA, 19 nt, Artificial Sequence
  siRNA Antisense Sequence
gcugucaaaccgcacgaac

SEQ ID NO: 4300 - RNA, 19 nt, Artificial Sequence
  siRNA Sense Sequence
uucgugcgguuugacagcg

SEQ ID NO: 4301 - RNA, 19 nt, Artificial Sequence
  siRNA Antisense Sequence
cgcugucaaaccgcacgaa

SEQ ID NO: 4302 - RNA, 19 nt, Artificial Sequence
  siRNA Sense Sequence
ucgugcgguuugacagcga

SEQ ID NO: 4303 - RNA, 19 nt, Artificial Sequence
  siRNA Antisense Sequence
ucgcugucaaaccgcacga

SEQ ID NO: 4304 - RNA, 19 nt, Artificial Sequence
  siRNA Sense Sequence
cgugcgguuugacagcgac

SEQ ID NO: 4305 - RNA, 19 nt, Artificial Sequence
  siRNA Antisense Sequence
gucgcugucaaaccgcacg

SEQ ID NO: 4306 - RNA, 19 nt, Artificial Sequence
  siRNA Sense Sequence
gugcgguuugacagcgacg

SEQ ID NO: 4307 - RNA, 19 nt, Artificial Sequence
  siRNA Antisense Sequence
cgucgcugucaaaccgcac

SEQ ID NO: 4308 - RNA, 19 nt, Artificial Sequence
  siRNA Sense Sequence
ugcgguuugacagcgacgc

SEQ ID NO: 4309 - RNA, 19 nt, Artificial Sequence
  siRNA Antisense Sequence
gcgucgcugucaaaccgca

SEQ ID NO: 4310 - RNA, 19 nt, Artificial Sequence
  siRNA Sense Sequence
gggcaccguggauagagca

SEQ ID NO: 4311 - RNA, 19 nt, Artificial Sequence
  siRNA Antisense Sequence
ugcucuauccacggugccc

SEQ ID NO: 4312 - RNA, 19 nt, Artificial Sequence
  siRNA Sense Sequence
ggcaccguggauagagcag

SEQ ID NO: 4313 - RNA, 19 nt, Artificial Sequence
  siRNA Antisense Sequence
cugcucuauccacggugcc

SEQ ID NO: 4314 - RNA, 19 nt, Artificial Sequence
  siRNA Sense Sequence
cguggauagagcaggaggg

SEQ ID NO: 4315 - RNA, 19 nt, Artificial Sequence
  siRNA Antisense Sequence
cccuccugcucuauccacg

SEQ ID NO: 4316 - RNA, 19 nt, Artificial Sequence
  siRNA Sense Sequence
gccggaguauugggaccug

SEQ ID NO: 4317 - RNA, 19 nt, Artificial Sequence
  siRNA Antisense Sequence
caggucccaauacuccggc

SEQ ID NO: 4318 - RNA, 19 nt, Artificial Sequence
  siRNA Sense Sequence
ccggaguauugggaccugc

SEQ ID NO: 4319 - RNA, 19 nt, Artificial Sequence
  siRNA Antisense Sequence
gcaggucccaauacuccgg

SEQ ID NO: 4320 - RNA, 19 nt, Artificial Sequence
  siRNA Sense Sequence
cggaguauugggaccugca

SEQ ID NO: 4321 - RNA, 19 nt, Artificial Sequence
  siRNA Antisense Sequence
ugcaggucccaauacuccg

SEQ ID NO: 4322 - RNA, 19 nt, Artificial Sequence
  siRNA Sense Sequence
gggaccugcagacacggaa

SEQ ID NO: 4323 - RNA, 19 nt, Artificial Sequence
  siRNA Antisense Sequence
uuccgugucugcagguccc

SEQ ID NO: 4324 - RNA, 19 nt, Artificial Sequence
  siRNA Sense Sequence
ggaccugcagacacggaau

SEQ ID NO: 4325 - RNA, 19 nt, Artificial Sequence
  siRNA Antisense Sequence
auuccgugucugcaggucc

SEQ ID NO: 4326 - RNA, 19 nt, Artificial Sequence
  siRNA Sense Sequence
gaccugcagacacggaaug

SEQ ID NO: 4327 - RNA, 19 nt, Artificial Sequence
  siRNA Antisense Sequence
cauuccgugucugcagguc

SEQ ID NO: 4328 - RNA, 19 nt, Artificial Sequence
  siRNA Sense Sequence
acacggaaugugaaggccc

SEQ ID NO: 4329 - RNA, 19 nt, Artificial Sequence
  siRNA Antisense Sequence
gggccuucacauuccgugu

SEQ ID NO: 4330 - RNA, 19 nt, Artificial Sequence
  siRNA Sense Sequence
cacggaaugugaaggccca

SEQ ID NO: 4331 - RNA, 19 nt, Artificial Sequence
  siRNA Antisense Sequence
ugggccuucacauuccgug

SEQ ID NO: 4332 - RNA, 19 nt, Artificial Sequence
  siRNA Sense Sequence
acggaaugugaaggcccag

SEQ ID NO: 4333 - RNA, 19 nt, Artificial Sequence
  siRNA Antisense Sequence
cugggccuucacauuccgu

SEQ ID NO: 4334 - RNA, 19 nt, Artificial Sequence
  siRNA Sense Sequence
cggaaugugaaggcccagu

SEQ ID NO: 4335 - RNA, 19 nt, Artificial Sequence
  siRNA Antisense Sequence
acugggccuucacauuccg

SEQ ID NO: 4336 - RNA, 19 nt, Artificial Sequence
  siRNA Sense Sequence
ggaaugugaaggcccaguc

SEQ ID NO: 4337 - RNA, 19 nt, Artificial Sequence
  siRNA Antisense Sequence
gacugggccuucacauucc

SEQ ID NO: 4338 - RNA, 19 nt, Artificial Sequence
  siRNA Sense Sequence
gaaugugaaggcccaguca

SEQ ID NO: 4339 - RNA, 19 nt, Artificial Sequence
  siRNA Antisense Sequence
ugacugggccuucacauuc

SEQ ID NO: 4340 - RNA, 19 nt, Artificial Sequence
  siRNA Sense Sequence
ugaaggcccagucacagac

SEQ ID NO: 4341 - RNA, 19 nt, Artificial Sequence
  siRNA Antisense Sequence
gucugugacugggccuuca

SEQ ID NO: 4342 - RNA, 19 nt, Artificial Sequence
  siRNA Sense Sequence
cacagacugaccgagcgaa

SEQ ID NO: 4343 - RNA, 19 nt, Artificial Sequence
  siRNA Antisense Sequence
uucgcucggucagucugug

SEQ ID NO: 4344 - RNA, 19 nt, Artificial Sequence
  siRNA Sense Sequence
gccgguucucacaccaucc

SEQ ID NO: 4345 - RNA, 19 nt, Artificial Sequence
  siRNA Antisense Sequence
ggauggugugagaaccggc

SEQ ID NO: 4346 - RNA, 19 nt, Artificial Sequence
  siRNA Sense Sequence
ccgguucucacaccaucca

SEQ ID NO: 4347 - RNA, 19 nt, Artificial Sequence
  siRNA Antisense Sequence
uggauggugugagaaccgg

SEQ ID NO: 4348 - RNA, 19 nt, Artificial Sequence
  siRNA Sense Sequence
cgguucucacaccauccag

SEQ ID NO: 4349 - RNA, 19 nt, Artificial Sequence
  siRNA Antisense Sequence
cuggauggugugagaaccg

SEQ ID NO: 4350 - RNA, 19 nt, Artificial Sequence
  siRNA Sense Sequence
gguucucacaccauccaga

SEQ ID NO: 4351 - RNA, 19 nt, Artificial Sequence
  siRNA Antisense Sequence
ucuggauggugugagaacc

SEQ ID NO: 4352 - RNA, 19 nt, Artificial Sequence
  siRNA Sense Sequence
cucacaccauccagaugau

SEQ ID NO: 4353 - RNA, 19 nt, Artificial Sequence
  siRNA Antisense Sequence
aucaucuggauggugugag

SEQ ID NO: 4354 - RNA, 19 nt, Artificial Sequence
  siRNA Sense Sequence
auccagaugauguauggcu

SEQ ID NO: 4355 - RNA, 19 nt, Artificial Sequence
  siRNA Antisense Sequence
agccauacaucaucuggau

SEQ ID NO: 4356 - RNA, 19 nt, Artificial Sequence
  siRNA Sense Sequence
uccagaugauguauggcug

SEQ ID NO: 4357 - RNA, 19 nt, Artificial Sequence
  siRNA Antisense Sequence
cagccauacaucaucugga

SEQ ID NO: 4358 - RNA, 19 nt, Artificial Sequence
  siRNA Sense Sequence
ccagaugauguauggcugc

SEQ ID NO: 4359 - RNA, 19 nt, Artificial Sequence
  siRNA Antisense Sequence
gcagccauacaucaucugg

SEQ ID NO: 4360 - RNA, 19 nt, Artificial Sequence
  siRNA Sense Sequence
cagaugauguauggcugcg

SEQ ID NO: 4361 - RNA, 19 nt, Artificial Sequence
  siRNA Antisense Sequence
cgcagccauacaucaucug

SEQ ID NO: 4362 - RNA, 19 nt, Artificial Sequence
  siRNA Sense Sequence
agaugauguauggcugcga

SEQ ID NO: 4363 - RNA, 19 nt, Artificial Sequence
  siRNA Antisense Sequence
ucgcagccauacaucaucu

SEQ ID NO: 4364 - RNA, 19 nt, Artificial Sequence
  siRNA Sense Sequence
gaugauguauggcugcgac

SEQ ID NO: 4365 - RNA, 19 nt, Artificial Sequence
  siRNA Antisense Sequence
gucgcagccauacaucauc

SEQ ID NO: 4366 - RNA, 19 nt, Artificial Sequence
  siRNA Sense Sequence
augauguauggcugcgacg

SEQ ID NO: 4367 - RNA, 19 nt, Artificial Sequence
  siRNA Antisense Sequence
cgucgcagccauacaucau

SEQ ID NO: 4368 - RNA, 19 nt, Artificial Sequence
  siRNA Sense Sequence
ugauguauggcugcgacgu

SEQ ID NO: 4369 - RNA, 19 nt, Artificial Sequence
  siRNA Antisense Sequence
acgucgcagccauacauca

SEQ ID NO: 4370 - RNA, 19 nt, Artificial Sequence
  siRNA Sense Sequence
gauguauggcugcgacgug

SEQ ID NO: 4371 - RNA, 19 nt, Artificial Sequence
  siRNA Antisense Sequence
cacgucgcagccauacauc

SEQ ID NO: 4372 - RNA, 19 nt, Artificial Sequence
  siRNA Sense Sequence
auguauggcugcgacgugg

SEQ ID NO: 4373 - RNA, 19 nt, Artificial Sequence
  siRNA Antisense Sequence
ccacgucgcagccauacau

SEQ ID NO: 4374 - RNA, 19 nt, Artificial Sequence
  siRNA Sense Sequence
aggacgccuacgacggcaa

SEQ ID NO: 4375 - RNA, 19 nt, Artificial Sequence
  siRNA Antisense Sequence
uugccgucguaggcguccu

SEQ ID NO: 4376 - RNA, 19 nt, Artificial Sequence
  siRNA Sense Sequence
aggauuacaucgccuugaa

SEQ ID NO: 4377 - RNA, 19 nt, Artificial Sequence
  siRNA Antisense Sequence
uucaaggcgauguaauccu

SEQ ID NO: 4378 - RNA, 19 nt, Artificial Sequence
  siRNA Sense Sequence
aggaccugcgcucuuggac

SEQ ID NO: 4379 - RNA, 19 nt, Artificial Sequence
  siRNA Antisense Sequence
guccaagagcgcagguccu

SEQ ID NO: 4380 - RNA, 19 nt, Artificial Sequence
  siRNA Sense Sequence
cucagaucacccagcgcaa

SEQ ID NO: 4381 - RNA, 19 nt, Artificial Sequence
  siRNA Antisense Sequence
uugcgcugggugaucugag

SEQ ID NO: 4382 - RNA, 19 nt, Artificial Sequence
  siRNA Sense Sequence
ucagaucacccagcgcaag

SEQ ID NO: 4383 - RNA, 19 nt, Artificial Sequence
  siRNA Antisense Sequence
cuugcgcugggugaucuga

SEQ ID NO: 4384 - RNA, 19 nt, Artificial Sequence
  siRNA Sense Sequence
agaucacccagcgcaagug

SEQ ID NO: 4385 - RNA, 19 nt, Artificial Sequence
  siRNA Antisense Sequence
cacuugcgcugggugaucu

SEQ ID NO: 4386 - RNA, 19 nt, Artificial Sequence
  siRNA Sense Sequence
gaucacccagcgcaagugg

SEQ ID NO: 4387 - RNA, 19 nt, Artificial Sequence
  siRNA Antisense Sequence
ccacuugcgcugggugauc

SEQ ID NO: 4388 - RNA, 19 nt, Artificial Sequence
  siRNA Sense Sequence
cguguggcggagcaguuga

SEQ ID NO: 4389 - RNA, 19 nt, Artificial Sequence
  siRNA Antisense Sequence
ucaacugcuccgccacacg

SEQ ID NO: 4390 - RNA, 19 nt, Artificial Sequence
  siRNA Sense Sequence
guguggcggagcaguugag

SEQ ID NO: 4391 - RNA, 19 nt, Artificial Sequence
  siRNA Antisense Sequence
cucaacugcuccgccacac

SEQ ID NO: 4392 - RNA, 19 nt, Artificial Sequence
  siRNA Sense Sequence
cccaagacgcauaugacuc

SEQ ID NO: 4393 - RNA, 19 nt, Artificial Sequence
  siRNA Antisense Sequence
gagucauaugcgucuuggg

SEQ ID NO: 4394 - RNA, 19 nt, Artificial Sequence
  siRNA Sense Sequence
ccaagacgcauaugacuca

SEQ ID NO: 4395 - RNA, 19 nt, Artificial Sequence
  siRNA Antisense Sequence
ugagucauaugcgucuugg

SEQ ID NO: 4396 - RNA, 19 nt, Artificial Sequence
  siRNA Sense Sequence
caagacgcauaugacucac

SEQ ID NO: 4397 - RNA, 19 nt, Artificial Sequence
  siRNA Antisense Sequence
gugagucauaugcgucuug

SEQ ID NO: 4398 - RNA, 19 nt, Artificial Sequence
  siRNA Sense Sequence
aagacgcauaugacucacc

SEQ ID NO: 4399 - RNA, 19 nt, Artificial Sequence
  siRNA Antisense Sequence
ggugagucauaugcgucuu

SEQ ID NO: 4400 - RNA, 19 nt, Artificial Sequence
  siRNA Sense Sequence
agacgcauaugacucacca

SEQ ID NO: 4401 - RNA, 19 nt, Artificial Sequence
  siRNA Antisense Sequence
uggugagucauaugcgucu

SEQ ID NO: 4402 - RNA, 19 nt, Artificial Sequence
  siRNA Sense Sequence
gacgcauaugacucaccac

SEQ ID NO: 4403 - RNA, 19 nt, Artificial Sequence
  siRNA Antisense Sequence
guggugagucauaugcguc

SEQ ID NO: 4404 - RNA, 19 nt, Artificial Sequence
  siRNA Sense Sequence
acgcauaugacucaccacg

SEQ ID NO: 4405 - RNA, 19 nt, Artificial Sequence
  siRNA Antisense Sequence
cguggugagucauaugcgu

SEQ ID NO: 4406 - RNA, 19 nt, Artificial Sequence
  siRNA Sense Sequence
cgcauaugacucaccacgc

SEQ ID NO: 4407 - RNA, 19 nt, Artificial Sequence
  siRNA Antisense Sequence
gcguggugagucauaugcg

SEQ ID NO: 4408 - RNA, 19 nt, Artificial Sequence
  siRNA Sense Sequence
gcauaugacucaccacgcu

SEQ ID NO: 4409 - RNA, 19 nt, Artificial Sequence
  siRNA Antisense Sequence
agcguggugagucauaugc

SEQ ID NO: 4410 - RNA, 19 nt, Artificial Sequence
  siRNA Sense Sequence
cauaugacucaccacgcug

SEQ ID NO: 4411 - RNA, 19 nt, Artificial Sequence
  siRNA Antisense Sequence
cagcguggugagucauaug

SEQ ID NO: 4412 - RNA, 19 nt, Artificial Sequence
  siRNA Sense Sequence
auaugacucaccacgcugu

SEQ ID NO: 4413 - RNA, 19 nt, Artificial Sequence
  siRNA Antisense Sequence
acagcguggugagucauau

SEQ ID NO: 4414 - RNA, 19 nt, Artificial Sequence
  siRNA Sense Sequence
uaugacucaccacgcuguc

SEQ ID NO: 4415 - RNA, 19 nt, Artificial Sequence
  siRNA Antisense Sequence
gacagcguggugagucaua

SEQ ID NO: 4416 - RNA, 19 nt, Artificial Sequence
  siRNA Sense Sequence
augacucaccacgcugucu

SEQ ID NO: 4417 - RNA, 19 nt, Artificial Sequence
  siRNA Antisense Sequence
agacagcguggugagucau

SEQ ID NO: 4418 - RNA, 19 nt, Artificial Sequence
  siRNA Sense Sequence
ugacucaccacgcugucuc

SEQ ID NO: 4419 - RNA, 19 nt, Artificial Sequence
  siRNA Antisense Sequence
gagacagcguggugaguca

SEQ ID NO: 4420 - RNA, 19 nt, Artificial Sequence
  siRNA Sense Sequence
gacucaccacgcugucucu

SEQ ID NO: 4421 - RNA, 19 nt, Artificial Sequence
  siRNA Antisense Sequence
agagacagcguggugaguc

SEQ ID NO: 4422 - RNA, 19 nt, Artificial Sequence
  siRNA Sense Sequence
acucaccacgcugucucug

SEQ ID NO: 4423 - RNA, 19 nt, Artificial Sequence
  siRNA Antisense Sequence
cagagacagcguggugagu

SEQ ID NO: 4424 - RNA, 19 nt, Artificial Sequence
  siRNA Sense Sequence
cucaccacgcugucucuga

SEQ ID NO: 4425 - RNA, 19 nt, Artificial Sequence
  siRNA Antisense Sequence
ucagagacagcguggugag

SEQ ID NO: 4426 - RNA, 19 nt, Artificial Sequence
  siRNA Sense Sequence
ucaccacgcugucucugac

SEQ ID NO: 4427 - RNA, 19 nt, Artificial Sequence
  siRNA Antisense Sequence
gucagagacagcgugguga

SEQ ID NO: 4428 - RNA, 19 nt, Artificial Sequence
  siRNA Sense Sequence
cacgcugucucugaccaug

SEQ ID NO: 4429 - RNA, 19 nt, Artificial Sequence
  siRNA Antisense Sequence
cauggucagagacagcgug

SEQ ID NO: 4430 - RNA, 19 nt, Artificial Sequence
  siRNA Sense Sequence
acgcugucucugaccauga

SEQ ID NO: 4431 - RNA, 19 nt, Artificial Sequence
  siRNA Antisense Sequence
ucauggucagagacagcgu

SEQ ID NO: 4432 - RNA, 19 nt, Artificial Sequence
  siRNA Sense Sequence
cgcugucucugaccaugag

SEQ ID NO: 4433 - RNA, 19 nt, Artificial Sequence
  siRNA Antisense Sequence
cucauggucagagacagcg

SEQ ID NO: 4434 - RNA, 19 nt, Artificial Sequence
  siRNA Sense Sequence
gcugucucugaccaugagg

SEQ ID NO: 4435 - RNA, 19 nt, Artificial Sequence
  siRNA Antisense Sequence
ccucauggucagagacagc

SEQ ID NO: 4436 - RNA, 19 nt, Artificial Sequence
  siRNA Sense Sequence
cugucucugaccaugaggc

SEQ ID NO: 4437 - RNA, 19 nt, Artificial Sequence
  siRNA Antisense Sequence
gccucauggucagagacag

SEQ ID NO: 4438 - RNA, 19 nt, Artificial Sequence
  siRNA Sense Sequence
gcccugagcuucuacccug

SEQ ID NO: 4439 - RNA, 19 nt, Artificial Sequence
  siRNA Antisense Sequence
caggguagaagcucagggc

SEQ ID NO: 4440 - RNA, 19 nt, Artificial Sequence
  siRNA Sense Sequence
ugagcuucuacccugcgga

SEQ ID NO: 4441 - RNA, 19 nt, Artificial Sequence
  siRNA Antisense Sequence
uccgcaggguagaagcuca

SEQ ID NO: 4442 - RNA, 19 nt, Artificial Sequence
  siRNA Sense Sequence
gagcuucuacccugcggag

SEQ ID NO: 4443 - RNA, 19 nt, Artificial Sequence
  siRNA Antisense Sequence
cuccgcaggguagaagcuc

SEQ ID NO: 4444 - RNA, 19 nt, Artificial Sequence
  siRNA Sense Sequence
agacccaggacacggagcu

SEQ ID NO: 4445 - RNA, 19 nt, Artificial Sequence
  siRNA Antisense Sequence
agcuccguguccugggucu

SEQ ID NO: 4446 - RNA, 19 nt, Artificial Sequence
  siRNA Sense Sequence
ccaggacacggagcuugug

SEQ ID NO: 4447 - RNA, 19 nt, Artificial Sequence
  siRNA Antisense Sequence
cacaagcuccguguccugg

SEQ ID NO: 4448 - RNA, 19 nt, Artificial Sequence
  siRNA Sense Sequence
caggacacggagcuugugg

SEQ ID NO: 4449 - RNA, 19 nt, Artificial Sequence
  siRNA Antisense Sequence
ccacaagcuccguguccug

SEQ ID NO: 4450 - RNA, 19 nt, Artificial Sequence
  siRNA Sense Sequence
aggacacggagcuugugga

SEQ ID NO: 4451 - RNA, 19 nt, Artificial Sequence
  siRNA Antisense Sequence
uccacaagcuccguguccu

SEQ ID NO: 4452 - RNA, 19 nt, Artificial Sequence
  siRNA Sense Sequence
ggacacggagcuuguggag

SEQ ID NO: 4453 - RNA, 19 nt, Artificial Sequence
  siRNA Antisense Sequence
cuccacaagcuccgugucc

SEQ ID NO: 4454 - RNA, 19 nt, Artificial Sequence
  siRNA Sense Sequence
accuuccagaagugggcgu

SEQ ID NO: 4455 - RNA, 19 nt, Artificial Sequence
  siRNA Antisense Sequence
acgcccacuucuggaaggu

SEQ ID NO: 4456 - RNA, 19 nt, Artificial Sequence
  siRNA Sense Sequence
ccuuccagaagugggcguc

SEQ ID NO: 4457 - RNA, 19 nt, Artificial Sequence
  siRNA Antisense Sequence
gacgcccacuucuggaagg

SEQ ID NO: 4458 - RNA, 19 nt, Artificial Sequence
  siRNA Sense Sequence
cuuccagaagugggcgucu

SEQ ID NO: 4459 - RNA, 19 nt, Artificial Sequence
  siRNA Antisense Sequence
agacgcccacuucuggaag

SEQ ID NO: 4460 - RNA, 19 nt, Artificial Sequence
  siRNA Sense Sequence
agugggcgucugugguggu

SEQ ID NO: 4461 - RNA, 19 nt, Artificial Sequence
  siRNA Antisense Sequence
accaccacagacgcccacu

SEQ ID NO: 4462 - RNA, 19 nt, Artificial Sequence
  siRNA Sense Sequence
guggugccuucuggacagg

SEQ ID NO: 4463 - RNA, 19 nt, Artificial Sequence
  siRNA Antisense Sequence
ccuguccagaaggcaccac

SEQ ID NO: 4464 - RNA, 19 nt, Artificial Sequence
  siRNA Sense Sequence
uggugccuucuggacagga

SEQ ID NO: 4465 - RNA, 19 nt, Artificial Sequence
  siRNA Antisense Sequence
uccuguccagaaggcacca

SEQ ID NO: 4466 - RNA, 19 nt, Artificial Sequence
  siRNA Sense Sequence
ggugccuucuggacaggag

SEQ ID NO: 4467 - RNA, 19 nt, Artificial Sequence
  siRNA Antisense Sequence
cuccuguccagaaggcacc

SEQ ID NO: 4468 - RNA, 19 nt, Artificial Sequence
  siRNA Sense Sequence
gugccuucuggacaggagc

SEQ ID NO: 4469 - RNA, 19 nt, Artificial Sequence
  siRNA Antisense Sequence
gcuccuguccagaaggcac

SEQ ID NO: 4470 - RNA, 19 nt, Artificial Sequence
  siRNA Sense Sequence
ugccuucuggacaggagca

SEQ ID NO: 4471 - RNA, 19 nt, Artificial Sequence
  siRNA Antisense Sequence
ugcuccuguccagaaggca

SEQ ID NO: 4472 - RNA, 19 nt, Artificial Sequence
  siRNA Sense Sequence
gccuucuggacaggagcag

SEQ ID NO: 4473 - RNA, 19 nt, Artificial Sequence
  siRNA Antisense Sequence
cugcuccuguccagaaggc

SEQ ID NO: 4474 - RNA, 19 nt, Artificial Sequence
  siRNA Sense Sequence
agauacaccugccaugugc

SEQ ID NO: 4475 - RNA, 19 nt, Artificial Sequence
  siRNA Antisense Sequence
gcacauggcagguguaucu

SEQ ID NO: 4476 - RNA, 19 nt, Artificial Sequence
  siRNA Sense Sequence
gcaugagggucugcccaag

SEQ ID NO: 4477 - RNA, 19 nt, Artificial Sequence
  siRNA Antisense Sequence
cuugggcagacccucaugc

SEQ ID NO: 4478 - RNA, 19 nt, Artificial Sequence
  siRNA Sense Sequence
caugagggucugcccaagc

SEQ ID NO: 4479 - RNA, 19 nt, Artificial Sequence
  siRNA Antisense Sequence
gcuugggcagacccucaug

SEQ ID NO: 4480 - RNA, 19 nt, Artificial Sequence
  siRNA Sense Sequence
augagggucugcccaagcc

SEQ ID NO: 4481 - RNA, 19 nt, Artificial Sequence
  siRNA Antisense Sequence
ggcuugggcagacccucau

SEQ ID NO: 4482 - RNA, 19 nt, Artificial Sequence
  siRNA Sense Sequence
gucuucccagcccaccauc

SEQ ID NO: 4483 - RNA, 19 nt, Artificial Sequence
  siRNA Antisense Sequence
gauggugggcugggaagac

SEQ ID NO: 4484 - RNA, 19 nt, Artificial Sequence
  siRNA Sense Sequence
caucgugggcaucauugcu

SEQ ID NO: 4485 - RNA, 19 nt, Artificial Sequence
  siRNA Antisense Sequence
agcaaugaugcccacgaug

SEQ ID NO: 4486 - RNA, 19 nt, Artificial Sequence
  siRNA Sense Sequence
ugggcaucauugcuggccu

SEQ ID NO: 4487 - RNA, 19 nt, Artificial Sequence
  siRNA Antisense Sequence
aggccagcaaugaugccca

SEQ ID NO: 4488 - RNA, 19 nt, Artificial Sequence
  siRNA Sense Sequence
gggcaucauugcuggccua

SEQ ID NO: 4489 - RNA, 19 nt, Artificial Sequence
  siRNA Antisense Sequence
uaggccagcaaugaugccc

SEQ ID NO: 4490 - RNA, 19 nt, Artificial Sequence
  siRNA Sense Sequence
ggcaucauugcuggccuag

SEQ ID NO: 4491 - RNA, 19 nt, Artificial Sequence
  siRNA Antisense Sequence
cuaggccagcaaugaugcc

SEQ ID NO: 4492 - RNA, 19 nt, Artificial Sequence
  siRNA Sense Sequence
gcaucauugcuggccuagu

SEQ ID NO: 4493 - RNA, 19 nt, Artificial Sequence
  siRNA Antisense Sequence
acuaggccagcaaugaugc

SEQ ID NO: 4494 - RNA, 19 nt, Artificial Sequence
  siRNA Sense Sequence
ugcuggccuaguucucuuu

SEQ ID NO: 4495 - RNA, 19 nt, Artificial Sequence
  siRNA Antisense Sequence
aaagagaacuaggccagca

SEQ ID NO: 4496 - RNA, 19 nt, Artificial Sequence
  siRNA Sense Sequence
gcuggccuaguucucuuug

SEQ ID NO: 4497 - RNA, 19 nt, Artificial Sequence
  siRNA Antisense Sequence
caaagagaacuaggccagc

SEQ ID NO: 4498 - RNA, 19 nt, Artificial Sequence
  siRNA Sense Sequence
cuggccuaguucucuuugg

SEQ ID NO: 4499 - RNA, 19 nt, Artificial Sequence
  siRNA Antisense Sequence
ccaaagagaacuaggccag

SEQ ID NO: 4500 - RNA, 19 nt, Artificial Sequence
  siRNA Sense Sequence
uggccuaguucucuuugga

SEQ ID NO: 4501 - RNA, 19 nt, Artificial Sequence
  siRNA Antisense Sequence
uccaaagagaacuaggcca

SEQ ID NO: 4502 - RNA, 19 nt, Artificial Sequence
  siRNA Sense Sequence
ggccuaguucucuuuggag

SEQ ID NO: 4503 - RNA, 19 nt, Artificial Sequence
  siRNA Antisense Sequence
cuccaaagagaacuaggcc

SEQ ID NO: 4504 - RNA, 19 nt, Artificial Sequence
  siRNA Sense Sequence
gccuaguucucuuuggagc

SEQ ID NO: 4505 - RNA, 19 nt, Artificial Sequence
  siRNA Antisense Sequence
gcuccaaagagaacuaggc

SEQ ID NO: 4506 - RNA, 19 nt, Artificial Sequence
  siRNA Sense Sequence
ccuaguucucuuuggagcu

SEQ ID NO: 4507 - RNA, 19 nt, Artificial Sequence
  siRNA Antisense Sequence
agcuccaaagagaacuagg

SEQ ID NO: 4508 - RNA, 19 nt, Artificial Sequence
  siRNA Sense Sequence
cuaguucucuuuggagcug

SEQ ID NO: 4509 - RNA, 19 nt, Artificial Sequence
  siRNA Antisense Sequence
cagcuccaaagagaacuag

SEQ ID NO: 4510 - RNA, 19 nt, Artificial Sequence
  siRNA Sense Sequence
uaguucucuuuggagcugu

SEQ ID NO: 4511 - RNA, 19 nt, Artificial Sequence
  siRNA Antisense Sequence
acagcuccaaagagaacua

SEQ ID NO: 4512 - RNA, 19 nt, Artificial Sequence
  siRNA Sense Sequence
aguucucuuuggagcugug

SEQ ID NO: 4513 - RNA, 19 nt, Artificial Sequence
  siRNA Antisense Sequence
cacagcuccaaagagaacu

SEQ ID NO: 4514 - RNA, 19 nt, Artificial Sequence
  siRNA Sense Sequence
guucucuuuggagcugugu

SEQ ID NO: 4515 - RNA, 19 nt, Artificial Sequence
  siRNA Antisense Sequence
acacagcuccaaagagaac

SEQ ID NO: 4516 - RNA, 19 nt, Artificial Sequence
  siRNA Sense Sequence
uucucuuuggagcuguguu

SEQ ID NO: 4517 - RNA, 19 nt, Artificial Sequence
  siRNA Antisense Sequence
aacacagcuccaaagagaa

SEQ ID NO: 4518 - RNA, 19 nt, Artificial Sequence
  siRNA Sense Sequence
ucucuuuggagcuguguuc

SEQ ID NO: 4519 - RNA, 19 nt, Artificial Sequence
  siRNA Antisense Sequence
gaacacagcuccaaagaga

SEQ ID NO: 4520 - RNA, 19 nt, Artificial Sequence
  siRNA Sense Sequence
cucuuuggagcuguguucg

SEQ ID NO: 4521 - RNA, 19 nt, Artificial Sequence
  siRNA Antisense Sequence
cgaacacagcuccaaagag

SEQ ID NO: 4522 - RNA, 19 nt, Artificial Sequence
  siRNA Sense Sequence
ucuuuggagcuguguucgc

SEQ ID NO: 4523 - RNA, 19 nt, Artificial Sequence
  siRNA Antisense Sequence
gcgaacacagcuccaaaga

SEQ ID NO: 4524 - RNA, 19 nt, Artificial Sequence
  siRNA Sense Sequence
cuuuggagcuguguucgcu

SEQ ID NO: 4525 - RNA, 19 nt, Artificial Sequence
  siRNA Antisense Sequence
agcgaacacagcuccaaag

SEQ ID NO: 4526 - RNA, 19 nt, Artificial Sequence
  siRNA Sense Sequence
uuuggagcuguguucgcug

SEQ ID NO: 4527 - RNA, 19 nt, Artificial Sequence
  siRNA Antisense Sequence
cagcgaacacagcuccaaa

SEQ ID NO: 4528 - RNA, 19 nt, Artificial Sequence
  siRNA Sense Sequence
uuggagcuguguucgcugg

SEQ ID NO: 4529 - RNA, 19 nt, Artificial Sequence
  siRNA Antisense Sequence
ccagcgaacacagcuccaa

SEQ ID NO: 4530 - RNA, 19 nt, Artificial Sequence
  siRNA Sense Sequence
uggagcuguguucgcugga

SEQ ID NO: 4531 - RNA, 19 nt, Artificial Sequence
  siRNA Antisense Sequence
uccagcgaacacagcucca

SEQ ID NO: 4532 - RNA, 19 nt, Artificial Sequence
  siRNA Sense Sequence
ggagcuguguucgcuggag

SEQ ID NO: 4533 - RNA, 19 nt, Artificial Sequence
  siRNA Antisense Sequence
cuccagcgaacacagcucc

SEQ ID NO: 4534 - RNA, 19 nt, Artificial Sequence
  siRNA Sense Sequence
gagcuguguucgcuggagc

SEQ ID NO: 4535 - RNA, 19 nt, Artificial Sequence
  siRNA Antisense Sequence
gcuccagcgaacacagcuc

SEQ ID NO: 4536 - RNA, 19 nt, Artificial Sequence
  siRNA Sense Sequence
gcuguguucgcuggagcug

SEQ ID NO: 4537 - RNA, 19 nt, Artificial Sequence
  siRNA Antisense Sequence
cagcuccagcgaacacagc

SEQ ID NO: 4538 - RNA, 19 nt, Artificial Sequence
  siRNA Sense Sequence
cuguguucgcuggagcugu

SEQ ID NO: 4539 - RNA, 19 nt, Artificial Sequence
  siRNA Antisense Sequence
acagcuccagcgaacacag

SEQ ID NO: 4540 - RNA, 19 nt, Artificial Sequence
  siRNA Sense Sequence
uguguucgcuggagcugug

SEQ ID NO: 4541 - RNA, 19 nt, Artificial Sequence
  siRNA Antisense Sequence
cacagcuccagcgaacaca

SEQ ID NO: 4542 - RNA, 19 nt, Artificial Sequence
  siRNA Sense Sequence
guguucgcuggagcugugg

SEQ ID NO: 4543 - RNA, 19 nt, Artificial Sequence
  siRNA Antisense Sequence
ccacagcuccagcgaacac

SEQ ID NO: 4544 - RNA, 19 nt, Artificial Sequence
  siRNA Sense Sequence
uggucgcugcugugaggug

SEQ ID NO: 4545 - RNA, 19 nt, Artificial Sequence
  siRNA Antisense Sequence
caccucacagcagcgacca

SEQ ID NO: 4546 - RNA, 19 nt, Artificial Sequence
  siRNA Sense Sequence
gucgcugcugugaggugga

SEQ ID NO: 4547 - RNA, 19 nt, Artificial Sequence
  siRNA Antisense Sequence
uccaccucacagcagcgac

SEQ ID NO: 4548 - RNA, 19 nt, Artificial Sequence
  siRNA Sense Sequence
ucgcugcugugagguggag

SEQ ID NO: 4549 - RNA, 19 nt, Artificial Sequence
  siRNA Antisense Sequence
cuccaccucacagcagcga

SEQ ID NO: 4550 - RNA, 19 nt, Artificial Sequence
  siRNA Sense Sequence
gcugcugugagguggagga

SEQ ID NO: 4551 - RNA, 19 nt, Artificial Sequence
  siRNA Antisense Sequence
uccuccaccucacagcagc

SEQ ID NO: 4552 - RNA, 19 nt, Artificial Sequence
  siRNA Sense Sequence
cugcugugagguggaggag

SEQ ID NO: 4553 - RNA, 19 nt, Artificial Sequence
  siRNA Antisense Sequence
cuccuccaccucacagcag

SEQ ID NO: 4554 - RNA, 19 nt, Artificial Sequence
  siRNA Sense Sequence
gguggaggaggaagagcuc

SEQ ID NO: 4555 - RNA, 19 nt, Artificial Sequence
  siRNA Antisense Sequence
gagcucuuccuccuccacc

SEQ ID NO: 4556 - RNA, 19 nt, Artificial Sequence
  siRNA Sense Sequence
guggaggaggaagagcuca

SEQ ID NO: 4557 - RNA, 19 nt, Artificial Sequence
  siRNA Antisense Sequence
ugagcucuuccuccuccac

SEQ ID NO: 4558 - RNA, 19 nt, Artificial Sequence
  siRNA Sense Sequence
ggaggaggaagagcucaga

SEQ ID NO: 4559 - RNA, 19 nt, Artificial Sequence
  siRNA Antisense Sequence
ucugagcucuuccuccucc

SEQ ID NO: 4560 - RNA, 19 nt, Artificial Sequence
  siRNA Sense Sequence
aggaggaagagcucagaua

SEQ ID NO: 4561 - RNA, 19 nt, Artificial Sequence
  siRNA Antisense Sequence
uaucugagcucuuccuccu

SEQ ID NO: 4562 - RNA, 19 nt, Artificial Sequence
  siRNA Sense Sequence
ggaggaagagcucagauag

SEQ ID NO: 4563 - RNA, 19 nt, Artificial Sequence
  siRNA Antisense Sequence
cuaucugagcucuuccucc

SEQ ID NO: 4564 - RNA, 19 nt, Artificial Sequence
  siRNA Sense Sequence
gaggaagagcucagauaga

SEQ ID NO: 4565 - RNA, 19 nt, Artificial Sequence
  siRNA Antisense Sequence
ucuaucugagcucuuccuc

SEQ ID NO: 4566 - RNA, 19 nt, Artificial Sequence
  siRNA Sense Sequence
aggaagagcucagauagaa

SEQ ID NO: 4567 - RNA, 19 nt, Artificial Sequence
  siRNA Antisense Sequence
uucuaucugagcucuuccu

SEQ ID NO: 4568 - RNA, 19 nt, Artificial Sequence
  siRNA Sense Sequence
acucucaggcugcaagcag

SEQ ID NO: 4569 - RNA, 19 nt, Artificial Sequence
  siRNA Antisense Sequence
cugcuugcagccugagagu

SEQ ID NO: 4570 - RNA, 19 nt, Artificial Sequence
  siRNA Sense Sequence
cucucaggcugcaagcagu

SEQ ID NO: 4571 - RNA, 19 nt, Artificial Sequence
  siRNA Antisense Sequence
acugcuugcagccugagag

SEQ ID NO: 4572 - RNA, 19 nt, Artificial Sequence
  siRNA Sense Sequence
ggcugcaagcagugacagu

SEQ ID NO: 4573 - RNA, 19 nt, Artificial Sequence
  siRNA Antisense Sequence
acugucacugcuugcagcc

SEQ ID NO: 4574 - RNA, 19 nt, Artificial Sequence
  siRNA Sense Sequence
gcugcaagcagugacagug

SEQ ID NO: 4575 - RNA, 19 nt, Artificial Sequence
  siRNA Antisense Sequence
cacugucacugcuugcagc

SEQ ID NO: 4576 - RNA, 19 nt, Artificial Sequence
  siRNA Sense Sequence
cugcaagcagugacagugc

SEQ ID NO: 4577 - RNA, 19 nt, Artificial Sequence
  siRNA Antisense Sequence
gcacugucacugcuugcag

SEQ ID NO: 4578 - RNA, 19 nt, Artificial Sequence
  siRNA Sense Sequence
ugcaagcagugacagugcc

SEQ ID NO: 4579 - RNA, 19 nt, Artificial Sequence
  siRNA Antisense Sequence
ggcacugucacugcuugca

SEQ ID NO: 4580 - RNA, 19 nt, Artificial Sequence
  siRNA Sense Sequence
gcaagcagugacagugccc

SEQ ID NO: 4581 - RNA, 19 nt, Artificial Sequence
  siRNA Antisense Sequence
gggcacugucacugcuugc

SEQ ID NO: 4582 - RNA, 19 nt, Artificial Sequence
  siRNA Sense Sequence
caagcagugacagugccca

SEQ ID NO: 4583 - RNA, 19 nt, Artificial Sequence
  siRNA Antisense Sequence
ugggcacugucacugcuug

SEQ ID NO: 4584 - RNA, 19 nt, Artificial Sequence
  siRNA Sense Sequence
cccagggcucugauauguc

SEQ ID NO: 4585 - RNA, 19 nt, Artificial Sequence
  siRNA Antisense Sequence
gacauaucagagcccuggg

SEQ ID NO: 4586 - RNA, 19 nt, Artificial Sequence
  siRNA Sense Sequence
ccagggcucugauaugucu

SEQ ID NO: 4587 - RNA, 19 nt, Artificial Sequence
  siRNA Antisense Sequence
agacauaucagagcccugg

SEQ ID NO: 4588 - RNA, 19 nt, Artificial Sequence
  siRNA Sense Sequence
cagggcucugauaugucuc

SEQ ID NO: 4589 - RNA, 19 nt, Artificial Sequence
  siRNA Antisense Sequence
gagacauaucagagcccug

SEQ ID NO: 4590 - RNA, 19 nt, Artificial Sequence
  siRNA Sense Sequence
agggcucugauaugucucu

SEQ ID NO: 4591 - RNA, 19 nt, Artificial Sequence
  siRNA Antisense Sequence
agagacauaucagagcccu

SEQ ID NO: 4592 - RNA, 19 nt, Artificial Sequence
  siRNA Sense Sequence
gggcucugauaugucucuc

SEQ ID NO: 4593 - RNA, 19 nt, Artificial Sequence
  siRNA Antisense Sequence
gagagacauaucagagccc

SEQ ID NO: 4594 - RNA, 19 nt, Artificial Sequence
  siRNA Sense Sequence
ggcucugauaugucucuca

SEQ ID NO: 4595 - RNA, 19 nt, Artificial Sequence
  siRNA Antisense Sequence
ugagagacauaucagagcc

SEQ ID NO: 4596 - RNA, 19 nt, Artificial Sequence
  siRNA Sense Sequence
gcucugauaugucucucac

SEQ ID NO: 4597 - RNA, 19 nt, Artificial Sequence
  siRNA Antisense Sequence
gugagagacauaucagagc

SEQ ID NO: 4598 - RNA, 19 nt, Artificial Sequence
  siRNA Sense Sequence
cucugauaugucucucaca

SEQ ID NO: 4599 - RNA, 19 nt, Artificial Sequence
  siRNA Antisense Sequence
ugugagagacauaucagag

SEQ ID NO: 4600 - RNA, 19 nt, Artificial Sequence
  siRNA Sense Sequence
ucugauaugucucucacag

SEQ ID NO: 4601 - RNA, 19 nt, Artificial Sequence
  siRNA Antisense Sequence
cugugagagacauaucaga

SEQ ID NO: 4602 - RNA, 19 nt, Artificial Sequence
  siRNA Sense Sequence
cugauaugucucucacagc

SEQ ID NO: 4603 - RNA, 19 nt, Artificial Sequence
  siRNA Antisense Sequence
gcugugagagacauaucag

SEQ ID NO: 4604 - RNA, 19 nt, Artificial Sequence
  siRNA Sense Sequence
ugauaugucucucacagcu

SEQ ID NO: 4605 - RNA, 19 nt, Artificial Sequence
  siRNA Antisense Sequence
agcugugagagacauauca

SEQ ID NO: 4606 - RNA, 19 nt, Artificial Sequence
  siRNA Sense Sequence
gauaugucucucacagcuu

SEQ ID NO: 4607 - RNA, 19 nt, Artificial Sequence
  siRNA Antisense Sequence
aagcugugagagacauauc

SEQ ID NO: 4608 - RNA, 19 nt, Artificial Sequence
  siRNA Sense Sequence
auaugucucucacagcuug

SEQ ID NO: 4609 - RNA, 19 nt, Artificial Sequence
  siRNA Antisense Sequence
caagcugugagagacauau

SEQ ID NO: 4610 - RNA, 19 nt, Artificial Sequence
  siRNA Sense Sequence
uaugucucucacagcuugu

SEQ ID NO: 4611 - RNA, 19 nt, Artificial Sequence
  siRNA Antisense Sequence
acaagcugugagagacaua

SEQ ID NO: 4612 - RNA, 19 nt, Artificial Sequence
  siRNA Sense Sequence
augucucucacagcuugua

SEQ ID NO: 4613 - RNA, 19 nt, Artificial Sequence
  siRNA Antisense Sequence
uacaagcugugagagacau

SEQ ID NO: 4614 - RNA, 19 nt, Artificial Sequence
  siRNA Sense Sequence
ugucucucacagcuuguaa

SEQ ID NO: 4615 - RNA, 19 nt, Artificial Sequence
  siRNA Antisense Sequence
uuacaagcugugagagaca

SEQ ID NO: 4616 - RNA, 19 nt, Artificial Sequence
  siRNA Sense Sequence
gucucucacagcuuguaaa

SEQ ID NO: 4617 - RNA, 19 nt, Artificial Sequence
  siRNA Antisense Sequence
uuuacaagcugugagagac

SEQ ID NO: 4618 - RNA, 19 nt, Artificial Sequence
  siRNA Sense Sequence
ucucucacagcuuguaaag

SEQ ID NO: 4619 - RNA, 19 nt, Artificial Sequence
  siRNA Antisense Sequence
cuuuacaagcugugagaga

SEQ ID NO: 4620 - RNA, 19 nt, Artificial Sequence
  siRNA Sense Sequence
cucucacagcuuguaaagu

SEQ ID NO: 4621 - RNA, 19 nt, Artificial Sequence
  siRNA Antisense Sequence
acuuuacaagcugugagag

SEQ ID NO: 4622 - RNA, 19 nt, Artificial Sequence
  siRNA Sense Sequence
ucucacagcuuguaaagug

SEQ ID NO: 4623 - RNA, 19 nt, Artificial Sequence
  siRNA Antisense Sequence
cacuuuacaagcugugaga

SEQ ID NO: 4624 - RNA, 19 nt, Artificial Sequence
  siRNA Sense Sequence
cucacagcuuguaaagugu

SEQ ID NO: 4625 - RNA, 19 nt, Artificial Sequence
  siRNA Antisense Sequence
acacuuuacaagcugugag

SEQ ID NO: 4626 - RNA, 19 nt, Artificial Sequence
  siRNA Sense Sequence
agaggcaagauuuguuccu

SEQ ID NO: 4627 - RNA, 19 nt, Artificial Sequence
  siRNA Antisense Sequence
aggaacaaaucuugccucu

SEQ ID NO: 4628 - RNA, 19 nt, Artificial Sequence
  siRNA Sense Sequence
gcaagauuuguuccugccc

SEQ ID NO: 4629 - RNA, 19 nt, Artificial Sequence
  siRNA Antisense Sequence
gggcaggaacaaaucuugc

SEQ ID NO: 4630 - RNA, 19 nt, Artificial Sequence
  siRNA Sense Sequence
caagauuuguuccugcccu

SEQ ID NO: 4631 - RNA, 19 nt, Artificial Sequence
  siRNA Antisense Sequence
agggcaggaacaaaucuug

SEQ ID NO: 4632 - RNA, 19 nt, Artificial Sequence
  siRNA Sense Sequence
aagauuuguuccugcccuu

SEQ ID NO: 4633 - RNA, 19 nt, Artificial Sequence
  siRNA Antisense Sequence
aagggcaggaacaaaucuu

SEQ ID NO: 4634 - RNA, 19 nt, Artificial Sequence
  siRNA Sense Sequence
agauuuguuccugcccuuc

SEQ ID NO: 4635 - RNA, 19 nt, Artificial Sequence
  siRNA Antisense Sequence
gaagggcaggaacaaaucu

SEQ ID NO: 4636 - RNA, 19 nt, Artificial Sequence
  siRNA Sense Sequence
uuguuccugcccuucccuu

SEQ ID NO: 4637 - RNA, 19 nt, Artificial Sequence
  siRNA Antisense Sequence
aagggaagggcaggaacaa

SEQ ID NO: 4638 - RNA, 19 nt, Artificial Sequence
  siRNA Sense Sequence
uguuccugcccuucccuuu

SEQ ID NO: 4639 - RNA, 19 nt, Artificial Sequence
  siRNA Antisense Sequence
aaagggaagggcaggaaca

SEQ ID NO: 4640 - RNA, 19 nt, Artificial Sequence
  siRNA Sense Sequence
guuccugcccuucccuuug

SEQ ID NO: 4641 - RNA, 19 nt, Artificial Sequence
  siRNA Antisense Sequence
caaagggaagggcaggaac

SEQ ID NO: 4642 - RNA, 19 nt, Artificial Sequence
  siRNA Sense Sequence
uccugcccuucccuuugug

SEQ ID NO: 4643 - RNA, 19 nt, Artificial Sequence
  siRNA Antisense Sequence
cacaaagggaagggcagga

SEQ ID NO: 4644 - RNA, 19 nt, Artificial Sequence
  siRNA Sense Sequence
gcccuucccuuugugacuu

SEQ ID NO: 4645 - RNA, 19 nt, Artificial Sequence
  siRNA Antisense Sequence
aagucacaaagggaagggc

SEQ ID NO: 4646 - RNA, 19 nt, Artificial Sequence
  siRNA Sense Sequence
acccugacuuuguuucugc

SEQ ID NO: 4647 - RNA, 19 nt, Artificial Sequence
  siRNA Antisense Sequence
gcagaaacaaagucagggu

SEQ ID NO: 4648 - RNA, 19 nt, Artificial Sequence
  siRNA Sense Sequence
cccugacuuuguuucugca

SEQ ID NO: 4649 - RNA, 19 nt, Artificial Sequence
  siRNA Antisense Sequence
ugcagaaacaaagucaggg

SEQ ID NO: 4650 - RNA, 19 nt, Artificial Sequence
  siRNA Sense Sequence
ccugacuuuguuucugcaa

SEQ ID NO: 4651 - RNA, 19 nt, Artificial Sequence
  siRNA Antisense Sequence
uugcagaaacaaagucagg

SEQ ID NO: 4652 - RNA, 19 nt, Artificial Sequence
  siRNA Sense Sequence
uuguuucugcaaaggcacc

SEQ ID NO: 4653 - RNA, 19 nt, Artificial Sequence
  siRNA Antisense Sequence
ggugccuuugcagaaacaa

SEQ ID NO: 4654 - RNA, 19 nt, Artificial Sequence
  siRNA Sense Sequence
uguuucugcaaaggcaccu

SEQ ID NO: 4655 - RNA, 19 nt, Artificial Sequence
  siRNA Antisense Sequence
aggugccuuugcagaaaca

SEQ ID NO: 4656 - RNA, 19 nt, Artificial Sequence
  siRNA Sense Sequence
gcaaaggcaccugcaugug

SEQ ID NO: 4657 - RNA, 19 nt, Artificial Sequence
  siRNA Antisense Sequence
cacaugcaggugccuuugc

SEQ ID NO: 4658 - RNA, 19 nt, Artificial Sequence
  siRNA Sense Sequence
aaggcaccugcaugugucu

SEQ ID NO: 4659 - RNA, 19 nt, Artificial Sequence
  siRNA Antisense Sequence
agacacaugcaggugccuu

SEQ ID NO: 4660 - RNA, 19 nt, Artificial Sequence
  siRNA Sense Sequence
aggcaccugcaugugucug

SEQ ID NO: 4661 - RNA, 19 nt, Artificial Sequence
  siRNA Antisense Sequence
cagacacaugcaggugccu

SEQ ID NO: 4662 - RNA, 19 nt, Artificial Sequence
  siRNA Sense Sequence
ggcaccugcaugugucugu

SEQ ID NO: 4663 - RNA, 19 nt, Artificial Sequence
  siRNA Antisense Sequence
acagacacaugcaggugcc

SEQ ID NO: 4664 - RNA, 19 nt, Artificial Sequence
  siRNA Sense Sequence
gcaccugcaugugucugug

SEQ ID NO: 4665 - RNA, 19 nt, Artificial Sequence
  siRNA Antisense Sequence
cacagacacaugcaggugc

SEQ ID NO: 4666 - RNA, 19 nt, Artificial Sequence
  siRNA Sense Sequence
caccugcaugugucugugu

SEQ ID NO: 4667 - RNA, 19 nt, Artificial Sequence
  siRNA Antisense Sequence
acacagacacaugcaggug

SEQ ID NO: 4668 - RNA, 19 nt, Artificial Sequence
  siRNA Sense Sequence
accugcaugugucuguguu

SEQ ID NO: 4669 - RNA, 19 nt, Artificial Sequence
  siRNA Antisense Sequence
aacacagacacaugcaggu

SEQ ID NO: 4670 - RNA, 19 nt, Artificial Sequence
  siRNA Sense Sequence
ccugcaugugucuguguuc

SEQ ID NO: 4671 - RNA, 19 nt, Artificial Sequence
  siRNA Antisense Sequence
gaacacagacacaugcagg

SEQ ID NO: 4672 - RNA, 19 nt, Artificial Sequence
  siRNA Sense Sequence
cugcaugugucuguguucu

SEQ ID NO: 4673 - RNA, 19 nt, Artificial Sequence
  siRNA Antisense Sequence
agaacacagacacaugcag

SEQ ID NO: 4674 - RNA, 19 nt, Artificial Sequence
  siRNA Sense Sequence
gcaugugucuguguucuug

SEQ ID NO: 4675 - RNA, 19 nt, Artificial Sequence
  siRNA Antisense Sequence
caagaacacagacacaugc

SEQ ID NO: 4676 - RNA, 19 nt, Artificial Sequence
  siRNA Sense Sequence
caugugucuguguucuugu

SEQ ID NO: 4677 - RNA, 19 nt, Artificial Sequence
  siRNA Antisense Sequence
acaagaacacagacacaug

SEQ ID NO: 4678 - RNA, 19 nt, Artificial Sequence
  siRNA Sense Sequence
augugucuguguucuugua

SEQ ID NO: 4679 - RNA, 19 nt, Artificial Sequence
  siRNA Antisense Sequence
uacaagaacacagacacau

SEQ ID NO: 4680 - RNA, 19 nt, Artificial Sequence
  siRNA Sense Sequence
ugugucuguguucuuguag

SEQ ID NO: 4681 - RNA, 19 nt, Artificial Sequence
  siRNA Antisense Sequence
cuacaagaacacagacaca

SEQ ID NO: 4682 - RNA, 19 nt, Artificial Sequence
  siRNA Sense Sequence
gugucuguguucuuguagg

SEQ ID NO: 4683 - RNA, 19 nt, Artificial Sequence
  siRNA Antisense Sequence
ccuacaagaacacagacac

SEQ ID NO: 4684 - RNA, 19 nt, Artificial Sequence
  siRNA Sense Sequence
ugucuguguucuuguaggc

SEQ ID NO: 4685 - RNA, 19 nt, Artificial Sequence
  siRNA Antisense Sequence
gccuacaagaacacagaca

SEQ ID NO: 4686 - RNA, 19 nt, Artificial Sequence
  siRNA Sense Sequence
gucuguguucuuguaggca

SEQ ID NO: 4687 - RNA, 19 nt, Artificial Sequence
  siRNA Antisense Sequence
ugccuacaagaacacagac

SEQ ID NO: 4688 - RNA, 19 nt, Artificial Sequence
  siRNA Sense Sequence
guguucuuguaggcauaau

SEQ ID NO: 4689 - RNA, 19 nt, Artificial Sequence
  siRNA Antisense Sequence
auuaugccuacaagaacac

SEQ ID NO: 4690 - RNA, 19 nt, Artificial Sequence
  siRNA Sense Sequence
uguucuuguaggcauaaug

SEQ ID NO: 4691 - RNA, 19 nt, Artificial Sequence
  siRNA Antisense Sequence
cauuaugccuacaagaaca

SEQ ID NO: 4692 - RNA, 19 nt, Artificial Sequence
  siRNA Sense Sequence
guaggcauaaugugaggag

SEQ ID NO: 4693 - RNA, 19 nt, Artificial Sequence
  siRNA Antisense Sequence
cuccucacauuaugccuac

SEQ ID NO: 4694 - RNA, 19 nt, Artificial Sequence
  siRNA Sense Sequence
uaggcauaaugugaggagg

SEQ ID NO: 4695 - RNA, 19 nt, Artificial Sequence
  siRNA Antisense Sequence
ccuccucacauuaugccua

SEQ ID NO: 4696 - RNA, 19 nt, Artificial Sequence
  siRNA Sense Sequence
aggcauaaugugaggaggu

SEQ ID NO: 4697 - RNA, 19 nt, Artificial Sequence
  siRNA Antisense Sequence
accuccucacauuaugccu

SEQ ID NO: 4698 - RNA, 19 nt, Artificial Sequence
  siRNA Sense Sequence
cauaaugugaggagguggg

SEQ ID NO: 4699 - RNA, 19 nt, Artificial Sequence
  siRNA Antisense Sequence
cccaccuccucacauuaug

SEQ ID NO: 4700 - RNA, 19 nt, Artificial Sequence
  siRNA Sense Sequence
guccaccaugacccucuuc

SEQ ID NO: 4701 - RNA, 19 nt, Artificial Sequence
  siRNA Antisense Sequence
gaagagggucaugguggac

SEQ ID NO: 4702 - RNA, 19 nt, Artificial Sequence
  siRNA Sense Sequence
ccaugacccucuucccacg

SEQ ID NO: 4703 - RNA, 19 nt, Artificial Sequence
  siRNA Antisense Sequence
cgugggaagagggucaugg

SEQ ID NO: 4704 - RNA, 19 nt, Artificial Sequence
  siRNA Sense Sequence
caugacccucuucccacgc

SEQ ID NO: 4705 - RNA, 19 nt, Artificial Sequence
  siRNA Antisense Sequence
gcgugggaagagggucaug

SEQ ID NO: 4706 - RNA, 19 nt, Artificial Sequence
  siRNA Sense Sequence
augacccucuucccacgcu

SEQ ID NO: 4707 - RNA, 19 nt, Artificial Sequence
  siRNA Antisense Sequence
agcgugggaagagggucau

SEQ ID NO: 4708 - RNA, 19 nt, Artificial Sequence
  siRNA Sense Sequence
ugacccucuucccacgcug

SEQ ID NO: 4709 - RNA, 19 nt, Artificial Sequence
  siRNA Antisense Sequence
cagcgugggaagaggguca

SEQ ID NO: 4710 - RNA, 19 nt, Artificial Sequence
  siRNA Sense Sequence
gacccucuucccacgcuga

SEQ ID NO: 4711 - RNA, 19 nt, Artificial Sequence
  siRNA Antisense Sequence
ucagcgugggaagaggguc

SEQ ID NO: 4712 - RNA, 19 nt, Artificial Sequence
  siRNA Sense Sequence
acccucuucccacgcugac

SEQ ID NO: 4713 - RNA, 19 nt, Artificial Sequence
  siRNA Antisense Sequence
gucagcgugggaagagggu

SEQ ID NO: 4714 - RNA, 19 nt, Artificial Sequence
  siRNA Sense Sequence
cuucccacgcugaccugug

SEQ ID NO: 4715 - RNA, 19 nt, Artificial Sequence
  siRNA Antisense Sequence
cacaggucagcgugggaag

SEQ ID NO: 4716 - RNA, 19 nt, Artificial Sequence
  siRNA Sense Sequence
uucccacgcugaccugugc

SEQ ID NO: 4717 - RNA, 19 nt, Artificial Sequence
  siRNA Antisense Sequence
gcacaggucagcgugggaa

SEQ ID NO: 4718 - RNA, 19 nt, Artificial Sequence
  siRNA Sense Sequence
ucccacgcugaccugugcu

SEQ ID NO: 4719 - RNA, 19 nt, Artificial Sequence
  siRNA Antisense Sequence
agcacaggucagcguggga

SEQ ID NO: 4720 - RNA, 19 nt, Artificial Sequence
  siRNA Sense Sequence
acgcugaccugugcucccu

SEQ ID NO: 4721 - RNA, 19 nt, Artificial Sequence
  siRNA Antisense Sequence
agggagcacaggucagcgu

SEQ ID NO: 4722 - RNA, 19 nt, Artificial Sequence
  siRNA Sense Sequence
ucuccaucucugccucaac

SEQ ID NO: 4723 - RNA, 19 nt, Artificial Sequence
  siRNA Antisense Sequence
guugaggcagagauggaga

SEQ ID NO: 4724 - RNA, 19 nt, Artificial Sequence
  siRNA Sense Sequence
cuccaucucugccucaacu

SEQ ID NO: 4725 - RNA, 19 nt, Artificial Sequence
  siRNA Antisense Sequence
aguugaggcagagauggag

SEQ ID NO: 4726 - RNA, 19 nt, Artificial Sequence
  siRNA Sense Sequence
aucucugccucaacuucau

SEQ ID NO: 4727 - RNA, 19 nt, Artificial Sequence
  siRNA Antisense Sequence
augaaguugaggcagagau

SEQ ID NO: 4728 - RNA, 19 nt, Artificial Sequence
  siRNA Sense Sequence
ucucugccucaacuucaug

SEQ ID NO: 4729 - RNA, 19 nt, Artificial Sequence
  siRNA Antisense Sequence
caugaaguugaggcagaga

SEQ ID NO: 4730 - RNA, 19 nt, Artificial Sequence
  siRNA Sense Sequence
cucugccucaacuucaugg

SEQ ID NO: 4731 - RNA, 19 nt, Artificial Sequence
  siRNA Antisense Sequence
ccaugaaguugaggcagag

SEQ ID NO: 4732 - RNA, 19 nt, Artificial Sequence
  siRNA Sense Sequence
ucugccucaacuucauggu

SEQ ID NO: 4733 - RNA, 19 nt, Artificial Sequence
  siRNA Antisense Sequence
accaugaaguugaggcaga

SEQ ID NO: 4734 - RNA, 19 nt, Artificial Sequence
  siRNA Sense Sequence
cugccucaacuucauggug

SEQ ID NO: 4735 - RNA, 19 nt, Artificial Sequence
  siRNA Antisense Sequence
caccaugaaguugaggcag

SEQ ID NO: 4736 - RNA, 19 nt, Artificial Sequence
  siRNA Sense Sequence
cuucauggugcacugagcu

SEQ ID NO: 4737 - RNA, 19 nt, Artificial Sequence
  siRNA Antisense Sequence
agcucagugcaccaugaag

SEQ ID NO: 4738 - RNA, 19 nt, Artificial Sequence
  siRNA Sense Sequence
uggugcacugagcuguaac

SEQ ID NO: 4739 - RNA, 19 nt, Artificial Sequence
  siRNA Antisense Sequence
guuacagcucagugcacca

SEQ ID NO: 4740 - RNA, 19 nt, Artificial Sequence
  siRNA Sense Sequence
cacugagcuguaacuucuu

SEQ ID NO: 4741 - RNA, 19 nt, Artificial Sequence
  siRNA Antisense Sequence
aagaaguuacagcucagug

SEQ ID NO: 4742 - RNA, 19 nt, Artificial Sequence
  siRNA Sense Sequence
agcuguaacuucuuccuuc

SEQ ID NO: 4743 - RNA, 19 nt, Artificial Sequence
  siRNA Antisense Sequence
gaaggaagaaguuacagcu

SEQ ID NO: 4744 - RNA, 19 nt, Artificial Sequence
  siRNA Sense Sequence
gcuguaacuucuuccuucc

SEQ ID NO: 4745 - RNA, 19 nt, Artificial Sequence
  siRNA Antisense Sequence
ggaaggaagaaguuacagc

SEQ ID NO: 4746 - RNA, 19 nt, Artificial Sequence
  siRNA Sense Sequence
guaacuucuuccuucccua

SEQ ID NO: 4747 - RNA, 19 nt, Artificial Sequence
  siRNA Antisense Sequence
uagggaaggaagaaguuac

SEQ ID NO: 4748 - RNA, 19 nt, Artificial Sequence
  siRNA Sense Sequence
cuucuuccuucccuauuaa

SEQ ID NO: 4749 - RNA, 19 nt, Artificial Sequence
  siRNA Antisense Sequence
uuaauagggaaggaagaag

SEQ ID NO: 4750 - RNA, 19 nt, Artificial Sequence
  siRNA Sense Sequence
uucuuccuucccuauuaaa

SEQ ID NO: 4751 - RNA, 19 nt, Artificial Sequence
  siRNA Antisense Sequence
uuuaauagggaaggaagaa

SEQ ID NO: 4752 - RNA, 19 nt, Artificial Sequence
  siRNA Sense Sequence
ucuuccuucccuauuaaaa

SEQ ID NO: 4753 - RNA, 19 nt, Artificial Sequence
  siRNA Antisense Sequence
uuuuaauagggaaggaaga

SEQ ID NO: 4754 - RNA, 19 nt, Artificial Sequence
  siRNA Sense Sequence
cuuccuucccuauuaaaau

SEQ ID NO: 4755 - RNA, 19 nt, Artificial Sequence
  siRNA Antisense Sequence
auuuuaauagggaaggaag

What is claimed is:

1. A method of treating a subject having Birdshot Chorioretinopathy (BSCR), the method comprising administering to the subject an Endoplasmic Reticulum Aminopeptidase 2 (ERAP2) inhibitory nucleic acid molecule and an HLA-A29 inhibitory nucleic acid molecule.

2. The method according to claim 1, the method further comprising detecting the presence or absence of an HLA-A29 allele in a biological sample obtained from the subject.

3. The method according to claim 2, the method further comprising determining whether the subject has one or two copies of an HLA-A29 allele.

4. The method according to claim 1, wherein the HLA-A29 inhibitory nucleic acid molecule comprises an HLA-A29 antisense nucleic acid molecule, an HLA-A29 small interfering RNA (siRNA), or a short hairpin RNA that hybridizes to an HLA-A29 mRNA.

5. The method according to claim 4, wherein the HLA-A29 antisense nucleic acid molecule comprises a nucleotide sequence selected from the group consisting of SEQ ID NOs: 3871-4145.

6. The method according to claim 4, wherein the HLA-A29 siRNA molecule comprises a sense strand and a corresponding antisense strand selected from the group consisting of SEQ ID NOs: 4146-4755.

7. The method according to claim 1, wherein the ERAP2 inhibitory nucleic acid molecule comprises an ERAP2 antisense nucleic acid molecule, an ERAP2 small interfering RNA (siRNA), or a short hairpin RNA that hybridizes to ERAP2 mRNA.

8. The method according to claim 7, wherein the ERAP2 antisense nucleic acid molecule comprises a nucleotide sequence selected from the group consisting of SEQ ID NOs: 1-858.

9. The method according to claim 7, wherein the ERAP2 siRNA molecule comprises a sense strand and a corresponding antisense strand selected from the group consisting of SEQ ID NOs: 859-2748.

10. A method of treating a subject having Birdshot Chorioretinopathy (BSCR), the method comprising:
performing or having performed an assay on a biological sample from the subject to determine whether the subject comprises:
i) an HLA-A29 allele; and
ii) a functional Endoplasmic Reticulum Aminopeptidase 2 (ERAP2) protein or a nucleic acid molecule encoding a functional ERAP2 protein; and
administering to the subject a therapeutically effective amount of an ERAP2 inhibitory nucleic acid molecule and an HLA-A29 inhibitory nucleic acid molecule to the subject having the functional ERAP2 protein or the nucleic acid molecule encoding a functional ERAP2 protein, and having the HLA-A29 allele,
wherein the presence of the HLA-A29 allele and the functional ERAP2 protein or the nucleic acid molecule encoding a functional ERAP2 protein, indicates that the subject is a candidate for treating the BSCR by inhibiting ERAP2 and HLA-A29.

11. The method according to claim 10, wherein the ERAP2 inhibitory nucleic acid molecule comprises an ERAP2 antisense nucleic acid molecule, an ERAP2 small interfering RNA (siRNA), or a short hairpin RNA that hybridizes to ERAP2 mRNA.

12. The method according to claim 10, wherein the HLA-A29 inhibitory nucleic acid molecule comprises an HLA-A29 antisense nucleic acid molecule, an HLA-A29 small interfering RNA (siRNA), or a short hairpin RNA that hybridizes to an HLA-A29 mRNA.

13. The method according to claim 10, wherein the ERAP2 antisense nucleic acid molecule comprises a nucleotide sequence selected from the group consisting of SEQ ID NOs: 1-858 or wherein the HLA-A29 antisense nucleic acid molecule comprises a nucleotide sequence selected from the group consisting of SEQ ID NOs: 3871-4145.

* * * * *